United States Patent 10,407,724 (METHODS AND COMPOSITIONS FOR SCREENING AND TREATING DEVELOPMENTAL DISORDERS) - sequence listing, part 50

SEQ ID NO: 1131 - DNA, 105432 bp, Homo sapiens
ggacaaaggtcacaaaggatttattgttttggcaacaaagaagcaagaacctccctggaaaaggagttctaaagtcatcaggatgtggtgagcctgcatttagggagtgacttgatgtgataaataccttgtgaatcatcactgctgaggaaataacattattttaagattaaaatttccacacccatatgcatcttaaaaaagaaaaaaaaacaaaccaacagaatttcttttaggggtattggcgcagcctgaggagtgctatatttctccagtaagaaaataatgcaaaaaaggcaatgttcattgatctaagcttgagcccccagggaagcataaccacatgaacctgaatgaatatattctagaaggagggaagcaccagagaagttctttcactaataaccatcaacgtcttctgtgaatcaaatatcaaacaaagatagtcctaaaaagtttaatttccagagataggtaatttcctaactgaatacagaaacccatagggcccagggatcctgatttcctatgcaaaatggagggtaaaactggaggctaggatctgggctaaaagtatatacttctaacagtagcacaaagatgtttctcatctgattgatcaatattcatttggattgatatatcttaagtttactgggaatattgaacatccattgcaaaaatcaagagtgtagagtgatgacctccttttaggtcatatagaacaaggtttttcaacccccatccatggaccggggtactggtcctggcctggtaggaacagggccgcacagcaggaggcaagcaggccaaccaacaagcattaacgcctgagctctgcctcctgtcagatcagcagtggcattggattctcaaaagagcaggaaccctattgtgaagtgcagatgcgaaggatctaggttgtggtctcctaatgagaatctaatgcctctgaaagcattccctccctgaccccatttttcgtggaaaaattatcttccaccaaactggtggccaaaaggttgtggatgctgatatagaagacatgtaaatgaaaacaataaatggaattaaaaatttagagaaatgctcagaaaaatgaaaactatttgtgctccattaaagccatgcatagatagaatgtcttcatagaacctaggatccaaggttctatgaagacctcagctcaaccaggccaaaagcatcctgatttctcaatggccctcctcttccctctactggcagccctagaggtgtgcagctgtggctcttctggatctctaggatataacctgcctcagaaccatggcctgctaggcaggaacaccttggtgcttttgggccaaatgaggagaatctctcccttcttgtgtctaaaggacagaagtgacttcagattcccccaggagaaggtggaagtcagccagttgcagaaggcccaggctatgtctttcctctatgatgtgttacagcaggtcttcaacttctcacacaaagcgctcctctgctgcatggaacatgaccttcctggaccaactccacactttacgtcatcagcagctggaacacctggagacctgcttggtgcaggagatgggagaaggagaagctgggggcagtgggtgattgagggctctacactggccttgaggaggtatttccaggaatccatctctacctgaaagagaagaaataaagattgtgcctgggaagttgtcagagtggaaatcatgagatccttttcatccacaagtttgcaagaaagattgagaagtaaggatgaagacctgggctcatcatgaaatgattctcattgactaatctgccatatcacacttgtacatgtgactttggatattcaaaaagctcatttctgtttcatcagaaattattgaattagttttagcaaatactttattaatagcataaagcaagtttatgtcaaaaacattcagctcctggggcatccgtaactcagagataactgccctgatgctgtttatttatcttccttcttttttttcatgccttgtatttatgatatttatatattttatattttcatcttcacatcgtattaaaatttataaaacattcactttttcatattaagtttgcattttgttttattaaattcatatcaaagaaaactctgtaaatgtttctattctaaaaacaatgtctactttctctttttgtaaaccaaattgaaaatatggtaaaatgtattaactcattcatttcattcctattatatgtataaattgagtaaatggcaaactgtggggttttcttaaagaaatacaggtgaataaagcaaacacagtttctctcagtctaagagggaaagagacgtaaaaacaggacaaatatttatattatttcaattatgttaaatgctacaaagagaagtaaagaaaagtgatgttctcacatcagaagctttaggtataaatggtgcttggaaggaaaaaatattagatatccttcctaaggtgcatgggagatatgtaagtacacgtcttattggcaggtgggaattatgtgtctagaatgccatgggggaaggtgttaatttggggttctttattttatgtctgattatcggggtacgggaatggatgtagtcacataaatagaggggagaatgtgatgaggacataaactttatcctgcagaccctcagcagttaaaggaagggctgaagagtagagtctgcaaaacgccctgaggctgatagccagtgcagttagaagacaaaatagggaagaatcagggaaagactaatcaggaaaggatggtggtactttcagggaaggaagaccaaactatcctagtgaatctgaaaacagaagtcactggtgaccttgaccaatgatggaatatatggtttagtagaattaatggaacagaattaatggaacattccttctgaaactattccaatcaatagaaaaagagggaatcccccctaactcattttatgaggccagcatcatcctgatactaaagcctggcagagacgcaacaagaagagaattttagaccaatatccctgatgaacatcgatgcaaaaatcctcaataaaatactggcaaactgaatccagcagcacatcaaaaagcttatccaccaagatcaagttggcttcacccctgggatgcaaggctggttcaacatatgcaaatcaataaacgtaatccatcacataaacagaaccaaagacaaaaccacatgattatctcaataaatgcagaaaaggccttcgacaaaattcaacaggctttcatgtgaaaaactctcaataaactagctattgatggaacgtatctcaaaataataagagctatttatgacaaacccacagccaatatcttactgaatgggcaaaaactggaagcattccctgtgaaaactggcacaagacagggatgccctctctcaccactcctatcaacacagtattggaagttctggccagggaaatcaggcaaaagaaagaaataaagggtattcaataaggaaaagaggaagtcgaattgtccctgtttgcagatgacatgactgtatatttagaaaaccctattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacagttgctacaaagagagtaaaatacataggaatccaacttacaagggatgtgaaggacctcttcaaggagaactacaaaccactgttcaatgaaataaaagaggacacaaacaaatagaagaacattccatgcttgtgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcattgccaagacactcctaagccaaaagaacaaagctggagtcatcacgctacctgacttcaaactatactacaaagatacagtaaccaaaacagcacggtactggtaccaaaacacagatatagaccaatggaacagaacagaggcctcagaaataacaccacacatctacaaccatctgatctttgacaaacctgacaaaagcaagaaatggggaaaggattccttatttaataaatggttctgggaaaactggctagccctatgtagaaagctgaaactggatcccttccttacaccttatacaaaaattaattcaagacggattaaagacttaaatgttagacctaaaaccataaaaaccctagaagaaaacctaggcaataccattcaggacataggcatgggcaaagacttcatgactaaaacaccaaaagcaatggcaacaaaagccaaaatagacaaatgggatctaattaaactaaagagcttctgcacagcaaaagaaactaccaccagagtgaacaggcaacctacagaatgggagaaaaattttgcaatatacccatctgacaaagggctaatatccagaatctatgaagaacttaaacaaatttgcaagaaaaaatcaaacaaacccatcaaaaagtgggcaaaggatatgaacagacacttttcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaatgcttttacactgttggtgggaatttaaactagttcaaccattgtggaagacagtgtggcaattcctcaagaatctagaactagaaataccatttgacccagtgatcccattactgggtatatacccaaaggattataaatcatgctcctataaagacacatgcacatgtatgtttattgcggcactattcacaatagcaaagacttggaatcaacccaaatgtccatcaatgatagactgcattaagaaaatgtggcacatatataccacggaatactatgcagccataaaaaacaatgagttcatgtcctttgtagcgacatggatgaagctggaaatcatcactctaagcaaactgtcacaaggacagaaaaccaaacaccgcatgttctcactcataggtggaaattgaccagtgagaacacttagacacagggtggggtacattacacaccagggcctgttgtggggtgggggaatgggggagggatggcattaggagaaatacctaatgtaaatgacgagttaatgggtgcagcaaaccaacatggcacatgtatacatatgtaacaaacctgcacgttgtgcacatgtaccctagaacttaaattataataaaataaataaatttttaaaatgcctctgtgattttgatagggattgccttagatctgtagatcactttggagaacatgaagatcttaacaatgttaagtcttccaatacatgatggatataaataaatgtcttaccatttatttttgtcatctttaattttttcagcagtatttgatagtttccagtggatatgtctttcacctcctcggttaattttattcctgaatattttatgctttttgatgccattgtaaatgagagtattttcttaatttcctattaggattattcattgttagtatatagaaatacgactgatttttgtttgttgattttgtatcctgaaactttgctctattcatttataagttatcactctgtgtgtgtgtgtgtgtgtgtgtgtgtgatctttagaattttttacatataagactatgtcctctgccaacagaaatcattttatttcctcctttataatttggatgcttattatttgtttttgttgcctaatgactctggctaggacttcaaatactatggataagtagaagtgatgagaatggcatccttacctttttcctgagcttagaggaaaaccttttaggttttcactattgagtatgatgttaatggagggattttcatataatagcccttatcatgttgaggtaatttccttctattcctagtttattgatcctatttttaaatcatgaaaggacactgaattttgtcaaatggtttttcaccatcagttgaggtgatcatgcttttccccccttcattctgtttatttagtttcttacattgatttctatatgttgaaccatgtagccatggtgtataatccttttaatacgctgttgaattttgtttgcaagtattttgctgagggtttttgcctccatatagactcataaaattagtttggaagtgttctctcctctataatcttatggaagaatttgagaaggatcatgctaattcttttttggatgtttggtaaaattctccagtgaagccatttggtcctgggcttttcttttttcagaggctttaattattgattcagtctccttatagttctattgtgattttttatttctttgtgattcagtcttggtaagtggtgtttctaggaattcatccattttttctaggttataaaatttgttggagtatacgtgttcatagttgtctcttatgatctttttttatttctgtggcatcagttgtagtgtctcctcttgtgtttcttatttttgttttatgagtcttctctctctctttttaaaataatcctagtaagggtctgtcaatttgttgaactttttttaaaaaaaccgactcttagtttcagtgatttttaaaaattgctcttctattctctattttatttatctttgctccagttttattatttcctttcttctgctagatttgggttttgtttgtacttttctttagttacttaaggtgcaaagttctattgttgacttgaactctttcttctttttttagtgtcagcttttacagctgtaaatttcccacttagcactgttttcactgtattgcatgggttttggtatattttcttttaattttcatttattaaagattttctaatttctattgtgttccttcttaaattctagtctcatttagacacacattgttttctttttgttttcatgcattgggatatgaaatcagaccacttttattttctgggaaaatgaaatgagaaagaaagacaccgggtgttgcccaacactatctagaaacaatgtacatttcatttgttttcatcatatttacattcctttattgacataagctgaaaatgaaaatgaaaaaagtccaggaatggcaaaacaaatttgcacagtacaatatcacatgaaaagggaatatacatatgaccccaacttgtttcctagttcacttggtccaacaatctgagtgaacaagggaaaaacatttcattcccagtgtttgacagactaagaaaaatagctttggcagaattatcctgcattcgaaagatatgatgattaggttgaactctaaaatccaataaaaatgtgttgactgtattaactaataaaagttcttaattttgcaaaatatatttttagaaagaaagctcatttactatggaaactctggtctcaatttcaaaactttgagcattttaattgtttaacaatataaagagttaaatcattaaaaataatgaatactaaaatttacttggtttatttaaaaaacggctcccttctggtctctaccctcatatagacatgttgattttatcatggtatcatctaaatgtcatcaaatgacatgaaacctaggtttctgagtgatggaaaatgaatttacagctcacacacacactctgggaagtcggcctcacttgacaaaggcaagaaaggtggaaaaatgatgattttgagacacagaactactaccttcaaaaagtagtgtgtctaattactgtgagctgtgtgaatcagggagagttagtttagacatgtggctctatacatgacaccaggctggttaatttctattataaaaaagtagagggcaaactagagatgaagtcataatatagtttaacatagtactatgcaaaagctgaaaattatgttgctcttgcatttgaattcccagccatatatttcttaaaggaactagatatctagcacatttggcaattaactctataagcattatcgacactcagtaagagaagagtggaaatattagccattgtctattataatcctagcaaatatggccttaatgaaggaaaataatgtggtcacttatgaacaccttttagtatgaggaggaaatctgagaaattgctttagtaaaaattatttattgagtacattagacttggtgctgaggataatgcagtcaataagacagagtccagttactaaagagctgatttgccaaaggtggtcccataaataccatacaaagagaaagaatctagaggactgaggcagcttaacttcctatgcaaaaataaaaaagtaaaaccaaggctcaggattagagctataaattaatacttcacacatgatacagtttggatgtgttcccatccaaatctcatgttgaattgtaatccccagtgttggatgtgggacctagtgggaggtgattggattattggggctgatttcacattaatagtttagcaccatcctctcagtgctgtcctcacaataataagtgacttctcacgagatttagtcacttaaaagtgtgcagcacctccccactcactcactctcctgctctggccatgtgatgtgcctgctcccgcttcccttttggccataatcgtaagtttcctgaggcctccccagaagctgagcagacaccatcatgcttcctgtacagcctgcagaatcatgagccaattaaatcttatttctttataaattatccagttgtgggtatttcttcatagtagtgtgaaaacgtcctcatactacatgataatattcagtatttatccagttataagtttaggacaaatatgtgtttttgtttttgtttaatagagtcaacttggtctggaatctgtattagtgtatttttacactgctgataaagatacccgagactgggtaatttacaaaagaaagaggtttaatggacttacacttccaagtggctggggaggcctcatgatcgtggcagaagacaaggaggagcaagtcacatcttacatggatggcagcaggcagagggagagagcttgtgcagggaaactccaccttataaagccatcagatctcatgagacttatccactatcatgagaacagcatgggaaagacctgcccccatgattcagttacctcctactgggtccctctcacaacatgtgggaattctggatgagatttgagtggggacacagccaaactatatcagaatctataaaccccccttataaaactatgagacttattcactatcaagagaacagcacaggaaagacccgccccccatgattcgattacctcccaccagttctctctcaaaacacatgggaattgtgggagctacaattcaagatgagatttggatggagacacagccaaaccatttcaccttatttatcttttttgatctttgttggcttaaagtccattttgtctgaaattaaaatagcaacccctgcttttttctgttttctgtttgcttggtagatttttcttcagcccttattttgagcatacagatggcattcgagatgggtctcttgaagagaccctaccattgggtcttgcttctttatccaacttgccataatgtgccttttaagtggggcatttagcccatttgctttcaaggttcatattaatatatgtggatttcaccctgtcatcatgctattaattgattagaaagcaggcttgtttgtgcattgctttatagtgtcactggtctgtgtgcttaagtgtgcttttgtagtggctggcgatgtttttttcctttccatatttggcattcttttcaggacctcttgtaaggcaggtctggtagtaacaaattcccttggcatttgcttgtctgaaaagaattttatttctctttcacttatgaagcctagtttggctggatatgaaattcttggttggaatttttttttctttagaaatgctacctaaaggtccctcatctcttctcatttgcagaatttctgtggaaaggtccactgttagccttatgtggttccctttgtagatgacctgccccttctctctagctgcctttcacatttttctttcattttgaccttggagaatctgatgattatatatcttgaggatggtgtgtaatatctcgtgggggttctctgtaattcatgaatttgaatgttggcctctctaagtgaggtcgaggaagttttcatggatgatattctgaaacatgttttccaagttgattgctttttccctgtttctttcagggatgccaacgagttatagatttcatctcttgccataatcccatatttcttggaggttttgtttgttcttttttattcatttttctttatttttgtctgactgagttatttaggagaggcagtctttgagctctgagattctttcctcagcttggaactagtgcagttgtttgaaagaaaaaaaggaactctggcttttttgctggttctttcttgtgctggttctttctcatttgtgtgggctgatgttccttcaatctttgaagtttctgtccttttgatggatattttctttttttctttgatgcccttgggggtttgattatggtataagttgggtttagttgacaggcttcaatattagtctgctcctgggtcttggaggagcccccccgattactgcctacatgcctgtgcttctttttttgggtgttttgatccgcaggactcccttaggcagggccaccattggcagatatgctgtatccatgccaggtcagccctaatctgctgtctgtgtgctttctggggaaacacagggttacacctgtccacagagttcaggtggaagtgggaccgctgggttggaagttctagcaggtgtgggccatctggctatgagaggtgggggttggtggggctaccctccctgtcatgcaggtgtttccggggcaacaggaacctgtgccgctttgcaaattcaggcagaaataggaccaccaatctagaagttctagtggacatggcttatctgggctaccagtggcaagggtggatgggaatgcctgccctgctgtctagatgcttcctgggaaaacaggaggctgcacccactgtttaagttcccacagaattaggaacactgggtcagaagctctggcagctgttgacagcctgagtgccagtggccagggtgggtggggtcacatgctctgttctcctggtgttttacttgttttgcttataaagggaaatgttcattaagattctacctttagctgggtgtggtggctcatgcctgtaatcccagtactttgggaggccaaggcaggaggatcccttgagcctaggagtttgagataagcttgggcaacatggccaaattccttctctacaaaaaatagaaaaggcatggtgtacacctgtagtcccagctacttgagaggctaagatgggaagatcatctgagcctggggaggctgaggctgcagtgagctgtgattgtgccactccactccagcctgggcaacacagcaagatcctgtcttaaaaaaaaaaaaaagaaaaaaaaagattctaccttgaagctgttttcctggaatgcatctaaatgggagagtccagtttgaaccagtagagggcagaataacatttagcattcatcactggaatgtgtttgcacatgaggtgtatcaacagtaaggaaacaaaataactctagatattcatgtgtcttagtaagtacatttggttaattaacataaggccatgttatgttcatcattaatgaacccagccaagacttttttttttaaccaacactcaactgcttaaatgccttgctcatcaaagagacaccagagaacaaagctaagttataaaaaataaggatggaaaagcttccaaatatcccttaaaaaacaattatattggaaggtctaatggggtcagattagataataaataacaatctagaactagtattaggctaatatcactgattttatgcttaccttttaaaactttattctgtgttatttatttattctagattcccataaatatatttaccacttaaactgaaagacccatagaagacatttttaaaaattatttccacactagtttttccaattgataaggtgatcagtaacatagatttttgatccaactactgggaacaatttaaaacaatctgttcatcaatattgaataagaaaaataaactatcatctcaaatattttgatgagatatttgcaaagaaattatattcagtcataatttctaagacttcaaattaatgagaaacagatatgtgcaaatgagatcaggcatgtttctttttaaacaagtgaaattataaacaaaaatattcttctaaaaaattaggtaaaaggcagcaatgtctactttcccctgaaatatttaatattgtggtgaaataataacaatgtaaaacattatgaaacaagcaagaggaattaaagttataacatgaagacaatttggtcatgtagggtaaaaataaggctccttttgttccctcttaatgaacatcacatcataaatctagccactcttgtatcctcctattaccataaattggtttttgaagtttctgaactttctataaatgaaaacacattttagtttttctttatatttagctttttcactcaatgttatgtctgtgaaatcatccatactgttcatgtatgttgagtgtgttgtttttttcaagttttatgagccatttggatagtctcttttgtgaaattcctgttccaatctttctttttggtaagcactttctccttttcttattgatattgatttctctttttattttagttatttttatatatatcctagatacaactactttgttgggtaaatgtattgtaaataacatctttcagattgaagctgatctttttattcacttaaagttattaatcttaatgaagactaagttatcaaattttatttgatggttacttcacttttgtcctatttaaggaaacactgcttacagtaaccaagtacataaatatcatgtcatacagatatgctcttatgttttcttctagcatttttatatgtttagcttttgcatttaggtctatgatgcatctttattgtacatagtgaggtgggagtaacatggatattcagttgacacacaacatttaagaaaaaccttctaggcttattgaattgcagtgacatattaattacaaatcaggtgaccataaatatggcctgtattttggctctatgctcttctactgatccacttattttttatctttgtcccagacagactagcttagtattactcttctggatttgttcttttctttaaaacttgtctagcctaggtcttttgtactccagtgtaaatttcagaattttcttgttaatttccatagaaaaatctgttacaattttattgagattttttgagaaatcaacatcttaacaatattgaaacctccaatccattaacattgtatatcctgtcttcttcaatctgtgagaagcttattctttgccctttgaatgttggtcatatagtggtcattggccaggacataaagaagcgggctgatgcctatccttgtttttctatagcctcatctctatagacaacattctgtccacaagtgaagaacaaagccagaagcaaacaggtggaatcctcaggagagtctttttgtaataaggagaaagatctcatatttgatttttacttctgacaggctctctggtcccatcccacctattcccctaccctaccagctgtgagaccaacaagagagctgggctacacccaacttctgtcccctcatacttgtgagaattccaaaccccgcagaccctggtctacttgggggaacccgatcacagtcccacctcctaacagcatgaagtttcaagctatgcatactacctgactctttccctttaatccctgtaaaaaaaaaaaaaaaaaaaaaaaaaaagaaaagcaatagcagcaacaacaaaacccagtctctggcaaaatccagattcagatctaaagaaaatatattaaaaaaaatttaaaaaaacattgttccagtgcatgtgagtagtaaaatttcaaacttcattggtaggcaaatggcaccattggattggtctaaacatccaatcattggtcaagggttgataatctctcctaggtgaccacaaaacacctccatatggagcagatccctgagagaagttttctaattataacaggaataacttgtttcacaattcctttatacaatctcctagagcagtggtttccactttggcttcactttggaattatctgaaaagttttaaaaacactgatgctgaagcgcctgcttattttagaattaaaaggaattcttaacaattaaaaacaatttttgacaagggaaatgaaaaattagaaaatcaccaaaattatttttgagactagtataaaactgattatagaagagggctgaattagaacaaaacaaaaaaaaagttactacagatagaaaattatctacgtatagctacaagtaaaatatcagaaaaataatctagagacaggttaatattaaatcttaattgagtattgtttttctagaaatccaagaattctaaaaaaatctgttactataactcagtggattaagacacatgctcaaaataaagagctatatgaagttcctacctggaaactcttaatggtgcaaaaacattaattgcactcagactggagatgtgatgtgagagaaaatgaggagtcaagaatgactatgtgagaacctataaatgtgaactgcaactaacagaactggaaaagaataagagaaatcatttttcccccaggagattggttttgaataaccttactttgagtttaggtctaaaatgaaggtttcaaatggagagcacttggatatataattttttaacatgggaatgacttccaggctaaacatatgcatttggataaaatcagcatgggggaaagtttaggaaagagacctatgctaggagatgggctgtaccttttgctccacctagggcatagatcagcacaagatgatgcctctgctttcctggactcattcttcctccccctatgtcctttcctggacccattcttcctgcctccttttcactgtgaaaaactctattgactttaaattctttccagttattttcttttcaatgccatacatcatcatggccaagaatcaatcaggaaagctcactatattccttagagaaagctcctgtaatcagaaagcctgtgaatacaactttattgatcatttctgttcctattgctcattaataaattttgtcccttttgtcttttcattgtacatatattcgtacaatacttgcgtataagttaataaatgaaaggaatgaataaaaatttttcaaaagttacgattcagtcatgttttattcaattatgtgtattatattgttttagtcaataatttcattgtaataaataatttcatttatacaaattatttatgttaggcaacaatgaacttttacaaaattgtaacttgcgttaatttagaaagcagattatatgcctactgagcttgtacctctaagggtagaggttgaaaaacgatattagtagtaggtgtgaaaaattgttgactgcatttggcaagtaactttagaaagatatgagttcaagaaagtatttttcagtatgcaagcagagagctaaaagagaatcaagggaattcagaatcctacgagtaggatataaaaactgctgtgtttcccattcatggcaattctgaatgcatgtctttgttgtgatcattctacattcagactacacagagtcatatccagctattatgaagaggactccatatgacccaaagactctgagctttgagctggatggaattactagaaaatactttggattggtcccttcaagttagaataagcgtgccgtacatggggggcaaagagaaacattaatatttggtgacctgaaggtcgatatgtagcaaagtcactgctggtgagcaccaaatccaatttattttcattttggacacagggctacaccctgctttccttatagttagccaaggacatatgactaagtttttacctatacaatatggacagatgtcatggccctctgatggcttggctcatgtaaatttctcatgggtgattctcttttctcactttccattctatggcaaccttggacaccacatattgaagaaaatggaaagggcctagcatttgaatgtacttgatagagcccattcatctcaccattggcccacataaatctgacataggaattacatttggaaactggaataacatgctttgtctcctagagatatggtagtcaataccctgaaaacccaggaacaataccccacccttggattaatctggatatccattgcccctgccaaggtgtcaccaggggaagaggttattgaggacactgctactccatactattctatatcttccctcctctctttctctgctaatgaatgctacccagcaccagaaaggcctttatctcacattcctatgtgataggaattgtggctattcctcttcttcccctttcctatgtacatttaacttctccttccctagggagaggagggagagtgggttgggaaagggagtgaagagctaccaaggaaaaatcagatttcaaagaatagaaaatatgtcaagatatatttcaaatatattacttccagttaaagcataaatccattggtagaatttatgcctttaagccaaaactatgggttttcttcagatcataagtgaaataaaatgactttaccaaatgctaataagttgtgtctactcttaaaaatgacacaaaacaagcaaatacttcaagtaacatgcaaataagctacagacgtaaataagttccttaccttctgagcttcctgacctcgttagtctaagaacatcacaatgggcttcgagattattgtcatgggaccattcttattcatccaaaatgcctccttcttagaggtctgttttgggttcataatccctacaagtaggaaatcttttctgactctgtaccaaaggaccttttctcaatatctttcttctataaggtacattcaagcagttttttccttcattttaatttaatccaagagtgtgacttcctactgaatagagatttgtggagaccttgctgttgtaacttattcagcaattgctggatcagctaaagataagtttagagcaagctgttgggttaaaggaggctttcttagtgcaaacttttgctttaaagagaaaataagtcaatatcacgaggtgcaaaaacatagctccaagatctagaatggtgctagagaaaaaaataagaatgtgctttactcatccataaacgactatgaaaaaaccatatagtaaagaggacatcaatttccaggaattggaattttaattatttctaaagctctatcactgtgtttattctttaaaagagaaacatattaaaattctcatatttacttattagaaaatatgatttttatccaatattctatctgtttcaccttcactttttaatagtggccagtgaagtggtccctccacgtcgtcccctggtgataccaaaggcaggtgttgtcttccagtaccaaccacagtagaaactaagctatgataaatctcccttgcttcatgaaaatagaaatgctggatacaatccgagtcaacttaaatggatagttaagaatttaaaaaagagaaaacgagatatttagtttccagaaattaaaagagaattttaaaatttcatttctaccctctgtttcctcatcaatgtaatcactcttattccttaacttgcgttttcactcagcaccattcaacatactatgaacaagtttggatgtaaatgaatattctttacctaattagactgattgactgtatggtattctgtaatacaaagggaccattgctgacttaaccaatcctctataatagcatattaatttcactacaactgtcttttgtataaataaggcttcaataaataaatttgtatatatgtttgagctggcatatggacagtgtttttgtaatataaatacctagggctgcattttctgggtctggtggtttaataattttggtagattttactaaattaactataagtgtttttaaattttatacttctactgtatctactcttaccccaaccatcaccaagtaatctttttgttgttcatcagatctttcatttatttgaaatgagaggcatattatttggcatattatccactcacagctatttaggcttcttgtaaactgcctctatatttcttactcatatctctatcaggttcttaaaatatttgaactttttatttaaaatattaatactcacatattttaagggttttttttccatgtgatttgaattttctttatggccctttgctggatagattattttttccatttaatgtgttaaaatgtatttcttttttccattgtggccatagttttcgtattactcagaaagagctttcctgtctgaagatttaaaaatgttttacatacacatatttctagtatttaatagatttgcatttgtttcctacattttggtatactaggtataatgttttctacttattgagcatgccaggcattgttctgaagtgtttataattcaattcatcctcgtaaccatccaatgatttgggctgtttttattatactcaagagctgaatgacctgaggcatagagaagcagaataacatgctcacttctcaggagggaggcttctttttgtttcctatctctaattcctctaggtgtccatctactggtgaggcccagtaagaaatttctccatccaggtttcatctcaactagcatgagatctctgtgtcacaaaaggcttgaatatctgctggtgctattcgcaggggacacagtagcatgatcttttgtcggcaggtagctatcttccatcagcccctaaggaaatctggattctttcctgtcttctagtcatgacagaggcaagattctcatacaggcacttgaagatctcattcttgtccagattgtaaccttgagcccagtcaagggagcaagtgggactggagcagatttaatactccagtaggggtatatctatttcttcaaaaacatgattttattggatataggtttcacagctcattggctgtatatccaggatctgatgacatcatatgaattgtctagacatatttatataatggattatattttacattttttcccacgtactgaacatccttagcttgagcctaaactgtgctgtccttggacttagacctgtctggacttgcatcatggtcttagagtgggtttgttgtttatcctaaaaaggaacccattctaaggaagaaaagagttatatccacacctggtccagtcacaataactctgcttagcagtagaaggccaactttgacaaagccatgggtgtaacactaaggttaccccttggctcaaccttcatagctatttacctgagtgttgagcacgagaaggtcatttagtgttttttattttttttgtttgatttttaatatgtcaggcattattagtagcagaagacagtacatggcaatctaaaagagatgatttagggaaaaaaaatcttttatctcaaactttgcactctactctgtgtgtgtgtgtgtgtgtgtgttcaacatcacatgttgtgttttgttttttcagccaccttctcccaccctccccaacatacatgccctgaaaccctaagccctatggctcccactgcccagtaacccaccttccctccctccccaccacaccgtacgtgttttttgtttgtttggttttgttttattttgtttatgttcaacccctcagacagtcccaagtgctccaaggaaactttgtgctagaaattacagcatgaacctactagtgaagtctctaaaatcccttcttgatgagactcttaatcttgtgtcttcaattacaattcctgcagactgctgcaacataaatgctgaaatgtacagaatcctctctttgcctctctaatttgaacccataataagaacccacttagccagaggcatttcaggtacatttttattattttagttatttctgctcctgatctctatcccatccacagagtgtattatctttcttttccccctctactaggcacaaatgggtccttcaaagtatgtctcctcaaatcccaccattgagtctggaaatatgcttatttctttccaatttcatctagcctctttctcggatactcattcctccgtctaaagtaatgagagtggattaggaactattacttttttaaaaagatctgatacactgaataatacaccagctaagaattcaattctcagtgctttcaaaataaattcactttgatcccaaatgttttcatacagattggtaactgcattgttcatcttagagttaattacttagagtaattaaattttctccaaggatctatattttattttgtgtaaggcttatattgaaacataacttggaataaatttcactaaaacaatgtatgcttacctctcttatgtagactaaagttacatgatttattagtcaacggaatcctgtcctttgttctatttaaacctcacttcatcctttccaagagataaacatctctacctaaattgactgaacagcttttcacacctctaagaaactggattctttttgcattgaaggcaaaattcataggactgttattgtgttatggtcccttcctgcatacttactacgtaaccctagctacttacctctaaacacttactacatgctggctatcttctgcctactcataatgcttcatgtataaaatccaaagaaatgaagaaaattgccaccaaatctttattaatagctagtggccacctattttggacaacaaatgagtggccttttgactagaataatgggaagagtgttatattttataaaattgtaaaattgagccatttatgccattggcatgtactgttctaatattttcataatttaagtttttttaaaaagctgagcaaaaaacagatccttttagaactgctcaagatggtgctaatggtttctgtattacctggcagttgaagatataaccaaccatcaaccccggctgactgggaggaaagacacatcataagagtggggtcggcccggcacggtggctcacacctgtaatctcagcactttgggaggctaaggtgtgtggatcacctgaggtcaggagttcacgaccatcctggctaacatggtgaaaccctgtctctactaaaaatacaaaaattagctgggagtggtgacaggcacctgtaatcccagctacactggaggctgacgcaggaaattcgcttgaacccaggaggcggaggttgcagtaagccatgatcatgccattgcactccagcctgggcaacaagagtgaaactccgtctcaaaaaaaaaaaaaaaaaaaaaaaaaaaaaagttcaggaaagcattgtctaagatgatcagaaccattagttagaagagaggctcccatctggacttctgccctacacattatgttcttattttattgtgcccttgctatataagtgtaaaacccaccatttcactggaaaaagataaatacttcatttttcactctaagaagtagcatatctaaatggtccatccaggaataatggagagtctcaaaaacaaacatcagaacttaacttcttagcacaccacacaaacaagaaaggcttcatttctagacagtctcctcatatgtctaattggccatgacaatatggtactggtatctcccttctttcctttaatgctatattttaaaaagtctgcattcattcaatatttagagtgtccctgttaaatgttgaataatgtgctaaagagttaagaagccatgtccttactacaaagtaggtaatactctagttggaagaaagagaagtaacccattacagtacaatgaggtcagtgacatggtaagatttgtgctatgggcaagtagcaaataggttcagacaaatcagactataaaggctctccgtgaagggaaaaattttaagtgaatcatgaataacagaaatgttattaacacatataagggaaagaatatgtagctagcaaaagaaacagcttatgagcttaggttttctgtggccctaaattgaagctcagacaacaaattctgagatgaggattcttatgcaagtttattggagagagctatggaatcacatttgtgagaagaaaaggcaggacgattaggcaaaggggaaagctaacctgcagtgtagtcacaaaatggccttagccaataacaggaggctgggagggtggtctgaaactgggaagactcttcacaggtggagtaaggggacttcacacccccacgtagaccagtcattgaatacaagcagaccctagggaggagtagaaaacttgggctaaatgactttagccaaaggcaattccacaaatggcccccaactctatttaccaaacatttatacttctctatagaggagatcactggataagtttgccatttttcaccttggaatgaatcctctgtcctccagagtttggttttgtgtccacaacacattctttgtccaatcagcattgctatcgtggaagttttgatttcactcaaccacacggtatgaggaccagaaaccttagagaaaacaaaacaaaacaaaacttgctttagtccattttccttaaaaggcagatattgtcatggggtgcacctaggatatgacagttgctacatacagcttctttaataaggaaaatgtctgatttgctgctgtgaaaaggcagtgatagaaaaaaaatatatcttcatcaactaactcctatctagggtgctaacttttctccagatgtcataagaaatatgagatcagtagccttaaaaaaactatgccttcatctcttaaaaacttaccaaggctatcaagaagtaggggtacggcttactacgtgtagtcacaagaccagcagcaacagcatcatgtgagaactgttagaaatggaattactcaggccataccacagacctattgaatcagaaacagtgggatgggaccatgcaatcagggttttaacaaatcctccaggtgattctgattcatgttagaggtgggacttaacttacagcaggtgccctttacaagagttgtttttaatttttaaagtagagatgggatctcaccatgttgcttaggctgatctcacactcctgggctcaagcaatctgcctgccttggcctcccgaagtgctgggattacaggcatgagctactgcacccagcctgttctttttttaaatttcaaaaatataataatttttttttcctggttctaaaaggaatccttattcatgggagaaatatttaatccaaaaagtttaagtgaatgtaaattctatcccaaagacagtagtactatgaacattttcatgcatttcttttcatatacttttcatgaatgttttatttgtagaaaatatgatgatgctgttattattttgtaacctgcttttggatttaatgatttgtttagctcaatacatatagatgtaacaaaaatataactcagcctgcaaatacaaatgaacctacccatactccaagcctttccatgtgctactaagccaggagtccaatcttttaatacgtctctccttcccaatattcccaagtttagaactctggttttggagttttaaaagggcacacatatttagaagtaacaattttttattttgtgctaggcattgaggtggttatacaacaggatatcaacttaataaacctaaatgtttgggaaaacattagtatataaagtattagtttaaacttctaaatatgagtattattttctaaacgtttccatttgacagttcctccattctgttctcagttcttaaggaagcaatgtcaagagaaaggaaaatatcttttctttaattcaagacttcagagaccattgtaaacttgaataaagaaagctaggagaaaattattattattgttattattattttgcagtgatatttcacaatgctattcaggtttgagttgtcaacaacacagtgcaggcttttgagtcaggctgacttgggataagatctttgctctggtatctgcaagctctgtggcttgctacattactttgagcatgttatttcacctttacagtcttgttctcacttgagaaaaaaataattacagaaggcacttggtaaggtcaatttgaaaattggataatgtgttaaatgaaggatttggttccaaaaacttcctggtttaaagaacaacaaaaaattttctagaccatgagaagaaaagtaacttatatttgcagttccttgtggtatttctccttcctccacttcactacctttgtgtgaatttgaaggtaaacagatcaacccctggctgcaatgtgaagtcagcaaagacttgcttctgattgacagcctctgcttccttacccttcttcactattgcaggtgactgtctcactttcaggatcctattcggttcctactcttccctttcaaaccaagtctaaagtagcagccattactcatttgcattaattaaactgaactggagtatgcttcgttcctaagtttttacatttactactaacttttacctccaattatgcaatgcatctgacgtagaacatgacacatggtagtagaactagcatcagagttttgggctgtggctctgctcccttacagtggacgaaagtgggatagccaccaagcctcaactttagtttctctgcccccacgttgttccgtggtgacttctgagagttcctggctagaagagctggaatccctccatcactggcatctcccaggagcaggaaccctctcccttggcacgggtgtgcttctctccagccctcctccaagcagacatcccaaccaggggcaggctaattcagtctcctgttccttttgaccttcaccagccagactccctcatgcatatttctgataactgtgactcgttagatacattttaaattattatcttaatatgtaatattcacacaatttaatataaaaatttttagaggagctataaaatctctcccaccctaatctccttcttcagtcttccttcttctcctaaatacaggtaatcattgtaatttatttcttattctttatttatacacagtaaggacaaacgtaagttttatttaacattttcaccccaaatgtagcattttatgtacactgctctgtatcttgcctattttcaactttttaaaaagaaataccgtctcatttgtttctccagctgaatagtgttcctttatatgaatatgcctcaactgtctctaattaggaaaatcgagatggtttcttgacttttggtattactaatagtgctgcagagaataatattgtttgtaagttatttcacacgtgggcaagtttttgttgttgtggttgttgttgttttgttttgttttgagatagagtctcactctgttgcccaggctggagtgcagtggcatgatctcggctcactgcaacctccacctcccaggttcaggtgattctcttgcctcagccttccgagtagctgggactacaggtgcccgccaccatgcccggctaatttttgtatttttagtagagacagggtttcaccatattggccaggctggtctcgaactcctgaccttgtgatccaccctcctcagcctcccaaagtgctaggattacaggcctgagccaccacgcccagctgtgggcaagtatttttataggacacatttccaggcctagaatttatagatgaaaggctacatgcatctgtaatagatatcacctaattgcctccatagtggttgtactataaatggcatgcatgctatttaatttgtatttctattatcatgagtgagattgaacctcttttaatgtagttttttttctctgcaaactgttcatgtcctttcaccatatttctattgtgtctcctgtaatgtaaatattcactgtgtaataatattttcaaatcttaaaatgcaaattattcccaatatttctcattgtctctagcaatttctggcaaataagcaaatcattgcaatggagttctatgttaaggaaagtatttttacattagtggcatattttattgtatctacccagccagcctgtatgaaaatacacccatttgaagaatcaaccatattaatgaatttattttgacatacaaacaatttaaaatggatagaatatataaagccacattacaaaataaaaacaattgtggtcaatatgcacaatcttaaaacacagataaatatatatatacacaaaatcaaagcaatgtgattgtactataaattgtattaccactctatgaagaatcatgtctggagaagtcctctagtccctccacctacctcgggcttctaaactctgtagtaagctcttgcttcatgtcgttcaagggtcttccttgtttgctcagtttttctgtgagactgaacacaaagaacagacatcggctgatttctacttggacaatggcccaggcacaggtgctgtagtcctggttttccaggtaatcatggatccttcggaagtacattttaacttgtaatctaaggttatcactacccaaagtaccacttagcttctctgcttccagtcccatgagtgcttctaggtattctagctgttgatgaagttgaatgaggaatttctccgtgtggttttcctcccaaccatccagagaaatatttgccctgaagaggctgaagatctgctgaagcatctcatggagaatggccagagtgtgtcctttttggtactgctgaggactcaaagacttctgaggaagcagaaagtttttcctgtgtggtagacactgctgaattgacaaggtttgcaacttattcaagagttttaaactttcttgattcacttgtctttgctggaagataatcagtttcaaatctagagagaagatagtggtagaggccagcagcaccaacacagttccaaagaagtgcttgataatcatggtgaaggtcaaatatgctacttatccctgcatagacttagggaaattccagctctagtgaatgtttgcctttcatgcatctcagattattttggagagtgttctcttttgttgctttcgttttctaatgtcatttctccaagtttacacattagattttcaggttcccttttcatggtgttcagagtacattttctccatttccctattgtgttggctattttgaggaagtaccaaaataacttattcattgtatgctttccttgaggcaattacagactagtcatccaacataatcttttattattctattcattatatacaaagtttcactgaacacaatgtgctttctaaatatttagtcaagcttattaaagttcttttattgagattacgtttttttcagtaatagtctttcatggagtaaaacttaccaaaggcttatcagcacctataaagaattcaggggcaaaacttaaaatacctacaaactactaaatttaaaacctcaattagaactgtaaattgtcacaaatgcttgagcaaataattaattttaaaacatatatcagcaatcttaaattattttatatcttatcctatcagtttaatatctaagattctagcctatagaagcaatgcaaaaaaattagcaaaagaagagtgttataatattattgcaaagcagaatattagaaacaacctataggttcaacgacaggtgaatgattacatatatgttggtacagccatataattaaatgatatatatccattatagatgacaaaattatatgtgaagagagattgggggcatttggttagcgtatattccctagaatagtgatagctctggtaaactaatgtgaacatctctacattaacaatgtcctttgaattacaaatacccagttccatattctaagttcctcttgaataagcccccaatatacctttccaatcttatcccactgttgctctaaatatagtgtgaaggaatctgaactccagataaagtaagtgatttagtattcccttaatacagctagcacttgtgtgtgtgtgtgtttattgatgatgctttctctgaaacatcaactgttgcctcctttacctcaagaacctttctgtgcaaggactaaagactacttgtcctttaaggcccagatctcccccaaggagccataatcttctggatccccacaacactttgtacctaccttatttaagacacctttcttgttctgtcttatacttgactatgtacttacatgattaaaagtctcttcagagtgtgaaataaacactgattactgatttctttgctgtctatacaactatagtagttgcttaataaatatgtgttgacttggaataaattaatatgttctacacaaagtaatacaagatgttgagtcttatctttaatcatttctctgcaggcagctgggtgaatccctaaatgtcaaaaacaggcactctgtaaacatgtatggtctcattatataccagctcagctgtatgtttggtcacttagtctagtattaataagttgaaataaactcagtcagcatgctccacagagggtcttttccctccctatctgagagagagagagagagagagagagagagagaaagagaaagagagagaaaagacatatgataatatataatatacgaaaggaataacacttgtttcataacattatgctcaatctatctggaaagtagaattttgactagtctcaaaaaatctttaaatatttaatgctgagcttcgggaaaacaatataaaaataaattaagaatatcagaagttactccatctaataacaacgagctctgatctataaggctttctcatcattttcattcaattgacaaaaatgatctaaatgttgtttaatttccaaatgatcagggattttccagatgcctttctgttactgatttcatatttgaatctgttgtggttaaagaatgtagtttaaatttattgagacttattttatggcttagaatatggtttatcttggtgacagttccttgtgaacttgaaataataatgttctacttttgttggttggactgttttataaatgtcaaataggttaagctgattgaaagtgtttgaaattttctgtatcctttctgatggtctatttgttctatcaactatcaagacagaagagctgaaatccctagtataattttagatttgcctatctcccatttcagttctatcagtttttgccttatatattttagaactttagtattaggtgcatcatatttaggattattatgtcgtcttgatgaattgacccctttattttaaaatgttcctctgtatcctttgcattattccttactcctaaatcaactttctctgataatcatttctgtttttttaattagtgttagcataatatgtcttttattgcatcttttaatttaacttattcatgttattatattaaagtgagtttcttgtacagagcgtatagttggaccttgtattttattctgtctgacaatctttgctttattagagtgtttaggtcattaaatttaatgtaattgtcagtatggctcagtttatatctaccactttattgtttgttttctaactgcccatatgttctttttctcacttttaagcttttccttccttcttttggattgaatttttgttgttgttttctattgcccattttatctccattattggcttgttagtaataccactttgttttactttttgttttcatagcagtttctctaggattaaaaatatacatctttatttaacatattacagtttaccttcaaataatattacaatccacttaaggtacagtgtagggatattataacagtatccttatatttcctctctctcattctttacactactttcactaatatttcttatattacacgtcccctggaaataaactctcttggcttttgtctgtctgaaaaagtattgtgtcttctttttgaaatatatttttgctgggtatagaattctaagttgatatattttttctttaagaactgtaaagatgttgctctactctattctggcttgcataatttctgaagagaagactgtggtcattcttaattttattcctctgtgcataatgtttcttctttttctctggcagcttttaagatttactatcactattttctagaaatttgataataatgtgctttggtgtgattttcttcttgtctcttttacaaggttttttttgagctttgtgaatccatgattttatcattttcatcaaatttgaaaaagtttcagactttatttcttttaacatttttctattaccattccctccttcctaatctcttctgggactacatctctagatgtgtttgactgtttaatattatcacacagttccctgaagctttgctcatttactttttagtcttttcctctgtcttatttctaatagtttctaagtctgccttcaagcttattggtatttcctttggtagtatcttatctacagttaatcccatccagtatatttatcacttcagatattatactttcatttgtagaagttgaatttgtttctttttcatatctacatttctttcctcatcacattcatcttttcctctacattcttgagcatatggagtacatttatagtaggtgtttaatctccttttctgataattctatcatttgtgtcatttctgagtctggtcttgtcaattatatttctactctttatgggtcctattttcctatgtcttttgcatgtttggtaacttttgagtggattctgagcattgtaaattttactttaatgggagttggatttgttaagtcctttacgtacagttgaactttgttttagggtatagttgagttacttggaattggattcctctgacattggctttgttagcatgagtgaagcagactttataatttagggcaatgcctttgtaaccaagaatatagtcttttgaggactctacttaatgctctctgaatttggagatttttgccctctggctgctggaaacatgaaatatccccagccctgtgttagcactggggacagcctgtactgcctgctcctttctgggtgttcttttcctaatcgggtaactcctttacgcacatacacaaaccacacattagctaaagactcctgaagacatttttacagatcttcgtagctctcattcattcttccccaatttccctctgtgcagcaatatcttctccaatatttttctgcctccctgaactccaaactatgacatatcaactcattgagaacactggtctgttggagtttcctcctctttgtgctgcagcctgccaattttctatccagcattaagctggagcaattgtagggcttactgtatttctttcctttctctcaaggatcattatcttacgctgtctgttatccaatgtctaaaaactatttttcgtatattttactcagtattctagttgttcaaagtgagatgataaatctagttgtccctcatgactagaagtggaggttctctcattataaataatctaaagtgggagttggcaaactatagcctatggaccaaatctgtcctaccacctcctgcttcttctttttttttttttttttttttttttttgagatggagttttgctttgtcgcccaggctggcgtgcagtggcttgatctcggctaaccgcaagctccgcctcccaggttcacgccattctcctgcctcagcctcccaagtagctgggactacaggcgcccaccaccacacccagctaatttttttatatttttagtagagatggggtttcactgttttagccaggatggtctcgatctcctgacctcgtgatctgcccgccttggcctcccaaagtgctggaattacaggcgtgagccactgcatctggcctaccacctacttttgtaaataaagttttactagaacacaatgatgctcatttgttatggcactttcatgctacaatagcaaggctgaatagttgtgataggaactatatggtctacaaaacctgaaatatttactctctggtcttttacagaaaggtttgctgaaccctgatctaaaagattaaaaacaaaatataattgtattcaaagtctagaaattttgaaaatgttttcacaaaaaatgtaatctaaagtaaatgttaaaaatattacatattttatattttcaaaaaacatgaaatattttatacaatgttatctatcaaaattaaaagacaacatgtgtggtataattaatatcaaatttaaactgacagtatttaaataaagcatatacttaaccttttaattaaaaacgtattaagcattaaaaatgtttataaaagtaaaattacatgcaattctatcttacaaggttcatatggataacaatgtaaaaaaaaatgtatcacacttccagcatatgtctagaccaacataaattaagatttaagagtaaaataaattgattaatattgagaaatattttccagcctccatgtacaactattgccaatgcccatcataatttatgagtccctcctgaatcactaattgttttttttttttttttttttttttgagcaacatggctctttatttcacctgggtgcaggcgggctgagtccgaaaagagtcagggaagggagataagggtggggccgttttataggatttgggtaggtaaaggaaaattacactcaaagggggtttgttctctggtgggcaggagtgggggttcgcaaggtgctcagtgggggtgcttttcgagccaggatgagccaggaaaaggactttcacaaggtaatgtcatcacttaaggcaaggactggccatttacacttcttttgtggtggaatgtcatcagttaaggtggggcagggcatgttcacttcttttgtgattcttcagttacttcaggccatctgggcgtatacgtgcaagtcacaggggatgcaatggcttggcttgggctcagaggcctgacattcctgccttcttatattaataagaaaaataaaacaaaatagtgaagtgttggggcggcaaaaatttctggcgggtgatatggacagagaatgggcgatgtttctcagggctgcttcaagcgggattggggcggcgtgggaacctagagtgggagagattaagctgaagggaggtcttgtggtaaggggtgatattgtggggatgttagaagaaacatctgtcatatagaatgattggttggcctggatacggtcttggatgaagtgacaaactaaatggaataagagaaggagaaaaacaggtataaaaggactaagaattgggaggacctaggacatctaattagagagtgcctaaggagattcagcatagtcctgccagcaaagattatttatttacttcaagagtttagagtggcagtttggggatagcaccaggagatatcagctgcgatggcttggagaaacagtgtaaaccagcagtgtaaacaagagcagggcatgtatgagtagttgagaacggtgaataggagtatgactaacagatgaggatgaaatttgggcttgactgaagtaatgggggctgtctgtgaagccttgcggcagtatagcccaggtaatttgctgagcctaatgggtgtcagggtcagtctaagtgaaggcaagtgttaacaggctttaatcctttcaaagcatgctgtgggatgggatattggcattgagccaggtaagggtgattaggttttaatgagatggtaaggggtgcatgatcggtcgccaaggagggagtagaggtatcttatacttgtgggttaagatgggggaatacaagaggaggacgcaaaagaggctttggattgggaagaagggcatcaatgagatgcggctatggtccaggaatagtcagggaagcagataatttggttaaaatgtctcagcctaataagggaactgggcaggtggggataactaaaaaggagtgcttaaaagagtattgtctaagttggcaccagagttggggagttttaagaggtttagaagcctggccgtcaatacccacaacagttatgggggcaagggaaacaggcccttgaaaagaaggtaatatggagtgggtagcctccgtattgattaagaaggggacagacttaccttccactgtgagagttacccgaagcttggcgtccgtgatggtctagggggcttccgaggcgatcgggcagcgtcagtcttcagccgctaagccaagaagatctgggaagcagtcagagagccttgggccagagttccagggactctgggagtggctgccaggtgagttggacagtccgattgccagtggggtcccgcacagatgggacacggcttaggaggaatcttgggctgcaggcattccttggcctggtggccacatttctggcacttgcagcaaactcctgggggaggaggttctggaggaatgcctggccgctgcggttcaggcgtttggaagttcttgtgtgctggagatgtggctggggtttgtctcacagtggaggcaaggagttgaaacttttttctattattgtacaccttgaaggcaaggttaattaaatcctgttgtgggatttgagggccggaatttaatttttggagttttatttaatgttgggagcagattgggtaataaaatgtatattgagaataagatggccttttgaccttttagggtctagggctgtaaagcatctcagggttgctgccgaacgagccatgaactgggctgggtttttatatttgatgaaaaagagcctaaacgctatctgatttgggataaagaaaaaggagcattaaccttgattatgcctttggctccagccacctttttaagagtaaattgctgggcaggtgggggagggctagtcacggaacgaaactgtaagcccgaccaggtgtgaggaggggaggcgataaaaagattatagggtggaggaacggaggctgaggaagaattgggacctagctcggcctggcgaggaggggagaggtcagatgggtctgtagaaaaggaagattagaaagactcagcgacgcttggggttgggactgaggggacaggcgggagggaaagaaggaagatttgggacgagttgcactgggcgcagagactaggaagggactgatgtgtaaaagaatgcctggatgtcaggcacctcagaccgtttgcctattttacgacaagaattatttagatattgcaggatggaaaaattcaaagtgccattttctggctatttggaactactgtcgagtttgtattggggtcaagcggcattgcagaagaaaataaggcatttaggttttaggtcaggtgaggattgaagaggttttaagttcttaagaatacaggctaagggagaagaaggaggaatggaaggtggaagcttgcccatagtgaaggaggcaagcccagagaaaagagtagagacacggagaaggggtgggggtttcttgccctccagaaaagcagagaaagggttggggcacagaaataagggattggggcgcagagataagaggttggggcatggaaataagcgattggggtgcagagataagaggttggggcgcagagataagaggttggggcatggaaataagcggttgggggttcttgccccctaggaaagcgggactcgccgctaagggtgaaggagaaggggttgaggggtacttgcccctgccccaggaaagcagagaaggggtagagacaaggagagaagaggttgagggctatttgcccctctcccagaaaagcagagaaggggtagagacaaggagagaaggggttgaggtacttgccccttccccagaaaagcgggacttgccgctaagggtgaaggaccaaggcaggcgtccctgcgtggtctgacacccttgaaacatggctgaatgatcagagaggcgtccctgcaatgattaaacaccaagggaaggctgccttcccaatccgtgaccggcgccggagttttgggtctatgaataaaacgtgtctcctttgtctctcccagaaaatgaaaggaattgaaattaagagaagggagagattgaagagtggaaaggagaaagtggttgagggacagtgagagaggttggagaagagagtaagatgaggccgcttaccggatttgaaattggtgagatgttccttgggctggttggtctgaggacctgaggtcgtaggtggatctttctcacagagcaaagagcaggaggatgggggattgatctcccaagggaggtcccctgttccgagtcaaggcaccaaatttcatgcgcgtccgtgtgaagagaccaccaaacagctgaatcactaattgttacgtaaagacaagcaagagaatggacactggggactattgagacatggtatttcattttgtaagaatctattgcgttcctgctgtccttgaggaagggtttactaggcaattaatgtgtcttctctttcctctgcagctcaaatcccctacattccaaggcaacgtctccttcatggcatcaggtacagtcaattttttgtaggggactgaaagcaagagatgtggagaaatatctccctgggtaccaaatggaattactaatgagcatgtatatttagagttattgggccatatgtgagcactgagtaccagatcctaagtgatgtgggtactagatgcttttttaaaatgttgtgtgtgtctatgcatgtgtgtgtatgtgcacttccgtgtgtgcatacacatgtgttgtataaattgaatcatgtctgatattcaggtttctcaaaagggcaagacctagagtagagcataggtcactcttgtctgaatctaaggatggtattaaggaaattcactgcatgcttacattgcttagagaaagacaatggaaagtgtcatgatgatgaaaaaagggctaaatcttaagtatcagtcagtatgacgaagtctctaaaataaattaaacaaacgactggtagttcatctttagctagaatgggcttttcaatgacttttaaatttattacataagtatcaagttttatttattcacttgtctccataaattatttatcattactgtcaatctaaaaaatgtaattaaaattgtgataccctctgtttaaaacacacaaaaacagttccagttagtaaacgaggcattttaaattcaaccaaaggatggcagcataatatcaattacttagagcctgggataaactttgctgttggtaagatatcacaaattaatggtatctagtggtctgataatgtatgatcagcaatacattactcagaccaggtgtattgttcccataacacattagctcactagtctgtctaatccatattaagatacttgctggttagtattgttatattttccttttttgccttgaccactctaatggacatgccttgctttctggccatctactacctcctctccctttctgggggtcggggggtgggggcgtctgtaaacatattctaacttctctgaccactctgggatcttgtgctctggccagactctccagcgtgccacacacagggtgccacatctagccctatcccaagctactcagcgcctccctttgctctggcctcagttattatttcagatatggttatttttcccaatggtatcgacacagctctactccattttctgagcataaactttcaaatatttgaccatattaatttatctatcatagaattctggagctggaattgatcttaaattgatatctaatctctgcttccctttccctttttgaaaaattcagtcctaaagacaatagatggacaaaacaatgtaagcattttgctggaaagggcaggaagccacactgctggagctcagacaggcaaaggtgactgtttatgtggagagagaacctggcatgggtgtcacagcctaagagtgattagagcatccgtggagcggggctgctgtggggagtcataacttgagtggagtgaggagaaatattctgtaaaacaattgccctgtaatcgttcaaggtcatgaaaatcaacaaagacccagcaactgctccagactataagagactaaagaatatagcaactgaatgcatagcatgattctgaacaggatccatttgctactaggaatattatagggtccaagcaccgtggctcacacctgtaatcccagcacttttggaggctgaggcgggtgtatcacctgaggtcaggagtttgaaaccagcctggccaacatggtgtaaccccatctctaccaaaaatacaaaaattagctgggtgtggtgacgggtgcctgtaatcccagctacttgggaggctgaggcaggagaatagcttgaacctgagaggtggagagtgccgtaaactgagattatgccactgcactccagcctgggtgacagaacaagactccatttcaaaaaaaaaaaagaatattattggattattgggactacaaatctaaatacgaacactgagtatcatatggtgctaacgtaacaatgttaatttctgaattttgttgtggttatgcagggaaaatatctctgttggtaggaaacacacattaaagtatttgacagtattggtgcatcagcttggcaacttaaattatttcaaaaataagattctctctcctgtattttcaactttcatgattatttcaaaggataaaaagtgtgtttgtattttttaactaaataatccacatttgagacatgatgacagaggtctaacagagcagaatagccttctttttgtacactatcatcaactatactgttctccctttccctcttcataatttaggccaagaatggcaaaagcacagtagaaaggaaaagaccaccacttctcatgaaaattgtataacatgatactcagcacatgggctttaatgtgcaacagaataggtttaaaccccaactctactacttgcttgctgtgtggtttttagcaagctattaacttctctgtgtctcagtttcatcaatgttaagacaagtataataatggtgtctcttggagttgttgtgaaatctaattgagataatccacctaatatgtttagtatagtgcatggcatgtaagccatgcataataaatgttattatttatgttattattaaaatatcatttatgctaaaatgatattattaatagataacggcagtctgttccatcaagctctaggtaagtactttcaaaatgctctgagggtagcccctattaatcagtcacagctggaaataagatgaagcccattttctattaactgctttttcaacaaatgtcaattaattcaaagaaagaagaaccaagtgtgtacatactctagaagcacttagatgacatgtattggtcctcatgttattaattcattcaagaaatgtttattgattgcttattatggtcctagcattgctccaggccctgttcagttaaacagagataaagatccctggaatggagtttgattggattaggtagggtaaaaggggagaaatagtagagtataagcaaatgacatagcacagcagtccccaacctttttggcaccaggaacctgttttgtggaagataattttttccatagaccagggtgggggaatggtttcgggatgattcaagcacatcacatttattgtgcactttatttctattactattatattgtaatgtatactaaaaataattatacaactcaccataatgtagaaccagtgggagccctgagcttgctttcctgcaactatctttctcatttggagggaaactatatttcccatctggaggtgatgggagacagtgacagatcatcaggcactagattctcacagggagcacgcaacctagatccctcctatgcctagttcacaacagggttcgcactcctatgagagaatctagtgctgccactgatctgacaggaggcagagctcaagaggtaatgtgagcagtggggagttgctgtaaatacagatgaagctttgcgcactcacccgctgctcacctcctgctgtgtggccctggttcctaacaggcaatggagcagtaccggactgtggcctggggattggtgacccctgttatagcattctataatgcagatgtataccagagtaaaatcaattacgagcatctctttttttctaaagttattgaccttctgtatacagaatgacacaaacaaattgctcaagatcaatccccaagaaacaccaatatttaagcaatgagtagaagaggagaccaaaaagtgaaataaacaatgtctaggccaggtgcagtggctcacacctgtaattccagcactttaggaggctgaggcgggtggatcacctgaggtcaggagttcgagaccagcctggccaacatggtgaaaccctgtctctactgaaaatacaaaaattagccaggcatggtggtgggtgcctgtaatcccagctactcaggaggctgaggcaagagaatcgcatgaactcaggaggcaaaggttgcagtgagccgagattgcgctatcgcactgcagcctgggggacaagagcaagacttcgtctcaaaaaaaaagagtgtctagatcagaaggaaaaccagttttcaagaacaaaggattgtgtaacagtgtcacacaccactaagtgggcaagaaaagtaagtacttgaaaacatatgttgaagttaattacatggacattatcagtgactttggcaaacggaattttcaatggagtattagggtggaagccagatttcaattcttataagaggaaatggaaataaacaacaaaatgatataggatatgcccacaaaaatttgatcactacatcgaagagaaaaattaactgaaaataggagtgagaggttcagtcttggcaagttttgttttttatcttgttttgttttttaaagtgagaaatattctctgttgattagaagaaaccagtagagtagggaagaaatggaaccagagcctcatgttgggcttggtctgtaacaggaaggagaaaagaataggatcaacacaggtttgagtgcaggtttagaagaggaagctcagtgtttcattctggtggtttctatttgttttcttgaagtggaagactagagcacgtgatggaccatctatgagattaacatgtgccctggcacattctattttctttgctttgaaacctgtcttgtctcccaattcaactcctcttcacccagctgacatgctcttacacatgggcttatagctccattcatagctatcattatagtctataagatttgtgaccatttgactaatttctctctctcccttcagagggtcctatccgtttctgtattttgcttacagtgcagccacacagtgtagcacactacattccagcccaaaatacagtagacacccaataaatatcccataaatattgaatgaataaatgaacttattcaatagaggagaaagaggtgttctaaacttgaagggagggggcaaattttagggttgtgatagaaagaatgtgagggagagttgacaaagacaggagagcaatattgagtatctgcttacatagattggtgaactaaattaatagaggcaccaatttgtcttgatttaaataagcagagaagattcacagtccatccaaggttgggactttggcaggtgagagtcaactgaatgacaatgaaacaagggattctaggatattggtaagagagctgtagaagtattagaccccatgatctacaacacataagtttgaattgtacatagattatcaaattcaggggcaacgtagttctccccaaaccctctgctcatgtttaagtcttaatattagtctttagtcttaacactttacgtacaatgtaatatttaatacacaagtcacactgttagatgtacagtgtcacttgtatgtccactcaaatggtgatatcgaaataacagccattacttactgagtatatattatgtataagacacttcttgaagagctttatgtatttggtcctcatcatctaattcttttctttccctcttaatcctcagcaggattctccggtaaaatatagtaaagaaacagagactcttagcataacaacacgtcaaagttacaagaagtggcctagttatcaagagaaaaatttatcctacagatgctccattgtgacaaaatttaaaaacctaagctttttaaaggtaaatgttaaaaggtacatgaacactctaaaaaagatgtaggcaagtatgaccatcatgattctgagaatgtttcatcatgtgtccaagagtgaaccaaaaacatgaacagaaaagggaggagagattaagacagagggaaaatggagtgggggagatgagagatatgaaaccctggacaaccatctgagatggatctctgtggactgaaaaacatctcattaaaagaagttaagagatagtttgaatgttctctaactctaggtgtgttcactgttgattaaccatgagattgttttatttctgggagtagacaacacacccttggctgtccaaaattattttattgacacttaatactcttactatgtgctaggcatttgtctaaaggaatcacaaatattattaataatttatttaatccacaaaactaccttatgaagtactattattatccccattgcacaaataaggaaactgagctactgacatattaaatccaaatgttgtgtgcattattgagagaataaatataatgttatttctaatctttataatattcttgagaggcaggtcttatgataataagatcattttaaaaatgaaaataaaagaaacctatgatttagaaaagttaacatttccaaacatggtcagctgggatttctacttctggtcatgagggactgacagggtcaagaattaccctccctctacaaacaatttaaaaactaaacaaaatataggaaacaactattttcagtcattgaagaatagccaatccaggactgtgatccctgagagatgggaaacaaatgaggctttttgcctgggggcaatttttagactgtgttgcagggaggaggaccctttctgagcaatctctctcagttcaggagacagagataaaagtctgaggaagccaaagcatatgaaatttgcaagacagagtacccaaaagaagtgagctacccagaaaaagagttctagaatttttttataagggtccccttgagtctttggtaaatgctaatgtgtacatgcactgggtaaagccctatgaggcccagcaagtacaacctccaaagaaagaataattgctggggagctttaagccaaacaacttaagcgcacattcaagactgaaaattgttcaagttcccaccagccacagggcaaaagaccctaaaagggctaaaacttaaatgtggggctaaattagcccgaaagtaaagactactacagatctgtcttaaaagaacataaaaacaagactttaatcaaactaatccacaattaccatagctgcctactgaaacaaaatccaacctgtttaaaggaatacaacaaaatccgtcacacaaaaacatacaatcacaataactggcattcaattaaaaaaaactaccagacacaggaaataagaatatataaactataatcaggagaaaaattaatagaaaataaatgagatgatagaattagcaaaaatattaaactgctatcataaataggctccatgtattcaaagatatacaagaaattaagtataaaaataaatgaaatcttgaaacaaatgttcaagatataaaatacaatatctgtaaaggtcattagatagccaaatacaacaaacaaagacaattgatagtaaataaaattaaaagtcagctccatgtgactgtaaggtattatcgttttccatggtgcattccattgtatggtgctctgtaaaaagccacagctaacaacaaaagcatgcatgtcaccccaaacagagggaccatgagtagagggacaaatggccatgacacaaggaaaagaacagttttagaatcaaaatagacagaggctcaaattctagctctgtaacttatcaactaggtaaacctacatgagtcttcggaaactgagtttattccttcatctgttaaatcaacatagaaaggcctacttcatacaaagcaataattgatactacaggtaagaaagtattaccatgttgcttgacacataggcacataaatcttttttccatagctgatagagaaaaaccctaaaattctcatgtatattcaagaaactaaagaaatattgctgattagaaggcctgacccaggctcaggaaaagttatggtgtggtgtgatgtggtgtgtgtgtgtctgagtgtgtgtgtgtgtgcatgtgtgtgtgtgtgtgtgtgtgtagggggttggtcctgggtgggtcagatgatatcaatgaacatatttttctctgaatagcatgcaaagtcttaatgaatactgctcttctgacctaaaaaaggtaacaggcattctaggtggaaatcatcacagaaaaggatctaccaatataatttaggaaatatagcaagtcaactttaccttggaattaatgctctgtttttctcttggaagaaacaacatactggatgtgtcagtgttttacactaagataatagtggctctgaaatctagcctaccaaatgtacagtgcttgggaagagagttaactttttagtaaggctccatttctgtaaaagaggaatgctgatgattaacttgcagagtaattataaggactaaagaagataacatgtataaattgcctagtaaagacattagtaatttaatatttatttattctctgaccctttgaagtcctgccccagccccccaattcatatttattttatctcttggtaccaagaaatcctccttttgtgggaactgaactaagattccattccactggccctctgatgtcaacttcttcagtttagacttgtcacttcttcctttcctgaagaaatatttgaaagattaaaagagacaaacaccagcgaagtcattgtaacctcacagggtttttgtcacatttggaattcattaatctgagttttgagaagaactcagttgacttcactccttggtagagcaaagagaaaaataaacgagaagacgatataatattaaagaactggaacctttgccctttgccttcttaatctggcctacatttctcaaggctctaagcaattaccaaatgacggagttgtctaaaatcaattctgcttactttgtgtaactaccaaaaatcagatatgaagactggtgcctgacctggtccagagattaatgagtttgctgagcaacgaagtctaactacctggttacacatttttcttggcacagtcaacagccaggaccaaaaggatgtgtgaaggctacggtctaaaatggttacaggaaatactgagattggtgcaagtggtatcaaaagaccagatgggaggctatccaaatgacctatagaatgctatgccagaaacccaagttcatctgaatgccaggtaaaaatacgcttgtgggctaacataagaattgccatctcaaacaaggtactttctaaataaatcagctaaaactaagacaagatattgctgcttaaaaaaatcttaattaaaagtgtaatattagatctgtaaagctcattataaagactaaaactggtgtgcctggggtacaaagagggaagagtgttagacagatgtacttagatacaatttcaattttttctgggcttaattacacttaaatattgggccaattaatcttcctgattaacttcctgagggcaccctagcttgaccccatctctcggtgtcaaacttcactttgactaacctaggaagctgggaaacccaatctgagccacctttggtcacgtataaatgcaaaatgaaagaggtcattctaaagtcgtgaaactgagagactgctgctcagagtggcttctcttgaaattcaagagaagatggcttggaagtggtaacacacacccaacaacaggtagcaattggggcacaggtgaagaaggctggaaagatgtcagtgtctttgataagcatcctgtgtggtgacagttcaacagttctcctgtttggggcaggaataaaggttcttaaaaacatcttaacacacagaaacaaatgtcctctttgtcactgagtctgtgctgtagatacagtcaggtcatataatgaaactattcatttgccttgggaatatgaactgagcttcttcctactcatctcatccattctgaaggtcaggacaagattaagatctccctgaaatgaatcaactcctggctagaggtgcaccgataattttcaaaatggtttaattacttcagtttctgaggccctcagagttgtttttttctttctgaaccatcaacatacatatttatgtaccaaacagaaaaaagcattaaaaaaaacaaattctattatggaaggcagaaaacagacactatgaaatagttgccagacagctattatttaggattgagtgcctagataccaagtattgtggtacttcaagactttgaggttgcatcacatggacttttaaaagggtgtaattttgaatcataactccgcattattttggctttcacatcaccatcccagacagtaaaaaaacagtgattattttcttaaatataagactgaacactatagtgtttaagtttagattagtaaaattgaacttttccacttctaattaatgtctatttctcattaacatatctggttataactagaaagttacatactgatggtgaaaggaaaatgtacatatgtgcatggtacaggataagtgtggtaggaagccaagggcattaaaagagaggcaataggtacagagcattttataatttgttgagatataaatacagacacaagcactttcttaaaataaaaaagcagtgatacattttctgaaagtctaaaaaattttacattagactttacaatagattaatttgtcattttgtttaattatcaggaggtaaatcactaagatcattggttctcagatttaatggaacaaatattttgcaagttgaagctaggtgctttactgctaaaattaaataaaagcaggcattttccaattcatacacaagttaatggatacagctttctaaattataagcatttttttctcataaatttgtcttaagccattagtgcaggcaattgtttatcttgtcttctcaaggtggtatctgatttgcctataatatacaattaaggttgtcatagcaatacttcatcgtgttctgttaaaagcaccatgactcctagatgttctttcccttaaagaagttacaagacaatagactaatactattgatctattggcagatgggtaatttcaagctgtgaaataaagagaaagaccaggcatgcttcccctgggcctcaaacagaaatgaggacactggatgtggtccgtggaaatgtagggcattgcatgcaaggcaatgtggatgtcgttggctgtcttttcaaaggatgacgttctagtgagtgatacacaattaacttcgagacttttcgggaagtcagtgctgtcattagttgtgccttatgtgtctccaaaaagaaacttgatttttacctacttgctttgcctttgaaacctagattgtaagggtttgaaatgatcataaattctattcacttaataaaaattctgtcagtcattttaacaaatatttactgagtgcctaccaatgatagcactgaaacctagatattccacatttgattccttagagattggttttaatgtttcattatatcgtttttcttggctttcctgagaagaacaagaagttgctagtttttagactcaactgtaattttgccatgtcctaacagctgcagaaaaaaacacacataccaaaacatattaacaaagaattacaaatattagctaaaggcaagagaaatgccatggaagactttgcattatcagcatgctgcttgattactacttttaaaaacagtccattaatgtttaaaaaattaaagaagactaggataaaggaatgctaaactgattctgggtacagccataaaaggctgttttcaggagcacatgaagacaagcaaaagatgagattaaattagaaatgggatattcatgctataggtataaaatgatttactgagatatttggtattacataacttaggaatgaaatcaaagttgaaaaatcttggaaatttcacagactattagactggatgactttaatctagagaaatcctttttattttcatggcttctctaacttcttcactcagcaaatcactgaacataaaatccatttgtggtgtgtcaaaagaacttgacctaaagttgagcgcaaagtgaagagactcagcctcacatcttctccagagttcatctaaaattattggaagcaataaaataagagatagtaaaagagagggcaaacacgaaatgttgggaatttacatgggctctatttagaaaaggtgaggaagaataaagaaaaagaatctttaaaatttaagactttttcgaatgttagcaatcctaaatcttgttaagtgtgtggcttgaaggacaaggcacattatgaaaaagagagaatcaataattggggtcataattttttaaatcaatacaactattttagtgtttgtggaagttctgttaagatatgagagtaggaaaataattcaaattttttaagtgtacttagatatataaatacttctatccagtgatggcatttggtgagtgtaggcagaaaaggctcacatcccttatgaagaggaactaccccattcataattcctatgactgagccagccacgttgtgtagcaggctggaggtggttggaccagaggtggtatatatgaccaaagggctgcctatgcgagaaacctataatgaggactggtccaaaaggagaactgggcccatcagtttctctcttgggaactgtaactgggacaggtaaagactgctacaattaacggtgggaggtgaagctgaaaggtcatgaagtagagacagatgatggtacccatacaattctctctaagacaagtctatggtaagagaaaaacgagtaaaaaaaagataaagtgaaaaagactctcagaggggagcagggaagcattgagcatagtcataaagaaaatgacaggtgaggaaaagagcatacccttaaagctgctttggttcctgacatcatctggtcccaggccttacaaattcttacactggaccccttctcctcaaggtagccagggcaagcatctgatccataaaatagagctaaccagaatagcttatataataaagcactgctggaaagcctgagcagagaaatatgtcctcatttattgaaagcaactgcagcattgtgtgtgtgtgtgtgcgtgtgtgtctgtgtgtgtgtgtgtttacaccttaaaagctgactccttggaagtactttgtatatgaaacagaacaaatgataattgctatgacagatattcaacaaatgtgttatatgtgcaaggttttgtactagatactgtgaagataaaaatatacagagaagacatgcactctatcttcaaacaatacttagaggaggatctcttttttctccctcacaaccacgaataagctgaagaataaattctgccctttaaacacggcaggtgcacaatgatgttttacagaaacaaatgctttatatgattgaatcacatacaatgcttttgggacacataggaaaaaaacaattttatttaagaggatcagggaagatttcatcaaagaaatgtaatcttcactgggcattatgggatgggcagttcttcagtaaaaagagaaacatggaaaaatacacaaaatggcatgacgatgtaaatgtgtgttagatttttagaacagtctgctttggttagggcacaggtacctgggagatgcaagaggaaaaatggtttggtgcaaatttgtggagcacattaattataaggctaaggagttatgactttattaagtaaaaaagcaagacactaagatcatcaaatgtatgttttaggaggataactctagcagacatggaaaacaggttcagattgggagaaaggcaggaaatagaggctgggagatgaattagaagattttaagctggctgcttgtgagctgggtatgaacaaaggcaatggcagcagtaatgggaagcagtgactacctgagagacactgcagagatgtagtcaacaggatttgacacatgattagatggggggaggaggtgtgagagtaggtgagaaaaaaaatgaaaggtaacattcaggttcccaatgtgaatgcttggcaaagcttttaaccaagataagacaagaagccatttagattgcagtaggattctggttttctaaggattgagtttgtggtacaaatggcacagccatttggggggatttaaaaagcagctagaaaatgcaaaactgcagtaaagcagagaagtctggactaaaaatgttaggtagcacatcttcagtgtgtgtaagagctgaaaaccaaatggtagatacagatgccctaggaagaaagagaaatcaagatttaaaagattggaaaactattgaaaatctgctttaagaggaagggtgaattcagtgactagtcagagagaagactgagaagacagttgttagaaatgtgatgaataagagtagtgccatgaacatcaaaaagggagccttgagggaactaatggtcaacaatgcgagtgactactgggttcgctgatgattcagtcatgaacacctcacctttggaagcagcagttccaatctaattatgagaacagaggatagattgtaacgggtcatgaagaaacagatgcaataaatattagctctttttgctagaagttagggcacaaagagaatatgatggatgggccagtaacaaagaggagtgacagcatccagggaagtttaatttttagatacacgagagggcagaagtgaataaacctgtggagagaatgtgaatatccaagaaaaaagttttgtttcatgagacagtgacattaaatccttcaatggcccctcatctaacttatgatattacttgtacttttcataaggcttaggagacctgtgttgggccccgtccgtgtattgcgcaccccatttcctcttttcaccgctattctcaacactccagacatgtcagttgttgatgtgccaagatttctagcttcacagctctcacatatgctgtctgggatactcttcccctgccccgcgaccccccctttttttttttttttttttttgcctgaacttaaataatatttcttccttaaagtggttttcctttaccacttcctgtctaaattaggtgtctttgttatgtttccatacacaaacaagaaagtccttcgccataataatcaaacttgcaatggttatcttttttcttagactgcaagtcatagaaaggtacggactatgtatggtacatgggaggtgctgaataaatactgaatgatgaataaataactgaaaaaatctaggtcatggcacaggaagtcaggaaaaggctttctgtgcttctaataaaactgctagaacttttatattcaattcaggtaatgatgcagagaagagttatctaattcaaaataattataagcaccatgtaataactttgaatgtgttacatttagggaaatatgcatctatagactctaatatttcaattttaatatatgggctttctcttattattggatttgtgaccttaccgccaattatatttgcttcctttgttttttttacctctttttcattctcaagtaccgattgttttttcaagtacactagacctggatctccttcccaagataacctctgtctctccaagatcctgcaatagctcaacacaattttttatgacaagtctccaaagtccaatatttgagtttcttatacacgttttacaaatcaggaaaggtttgcaagaagaaaggcaggtgagaaaacacaggcagggatcattctgggtcacacaaattccatgaatgctcttctataaaaactttcaatggccaagtaattaacttggaatcagcaagtcaaatcactcatttttttgcaaagttcagcaattagatagaacatatttccaaagaatgcaaaccacgaaggtggcttgcttccaagtaactacatcattttcctgtaatgccatcccagttggtttcctcatgcatgcttgatgattctcctcactatgcatctttttggacttccagattttgactcctaaacttatcaaattaactttattgacagaaagggtttctgcttttgttggatacatgtagattatgtgcctgctcagacagtgtaaactgccactctttggtaatcttatcttcaaataaggacacacacctgccctgatacttactcaaatacttactcagattgactaatgaacttataatgaactttcttatcatttaccaactgggctttgctctcaaggacataaaaactatgatctttacatctgggacatatcagtaattcttaacagtaaaaatatatgaccatgtatgcagttcatgggcaaagtccattaacactcacttaaaactaatattttcttcatccaagagtaataactaaacatacttcttaaactgaaccatgcattcaagaaaccttaggtaacatctaacgtgttatctataaagtctcccccagctacgcgacaggaggatcttgcttacccacattccaattagatttcccaaagtttggctacttgagcagcactttcacaatttttgtcatattccttgactataaatgccttaacattttatttaaattaattttaaaaatattaaaacaaatttacttttaaaaggagatgctgtgtatttttctaatgtatattaatatacaaaacattatatagaaataagaacatcatgtaggtttcagtgaaaactaaaagtactttggttttaatgctttggttttgtttgttttacaagacagggtcttgctatgttactcaggctggccttaattcctgggatgcagccatcctcccacctcagcctcccaagtagctgggattataggtgcatgccactgttcctcgctttaatatggttttgagacaagtattgattcagtaggaaatccattctagtggatccagccagtctgccctacctttctgcttctgcattcctagatgagatacctgaaaggggatggactcaacaacacaaatctcctatcagtctagctgctacaaatacaatggtaaacgattaaaatcctacaaattaaaacagtatagccaggcttagaataaaatattttaattttttaaaaattttaatcatttcaaaagcaaacttttgtaggagtgaaaggaaaaacggagggttgaaaagaatttataagccatatcttagaacttttatttgtacagcttcttaccattctcaaagcagttttatataccttacctgatttgagtctcataataagccaataacataaaaagcaagtatatgagtcatagaataattatcattttatttctaggcttttagatagagtaagagaagcaggacctttcctcaagataaaactaaaataccacgtttcttctgtttttgactggaattatttagcaaataagtgcttcaggttggatgagaacaaaggttatctgccttctatccagaactctgctttttttctcacatttaagttagacaaaaacaacataaaacaataaaacactgaaataaatttaaatacaattactaaaaaaacccaactttttttataaattgtcttccaatttgcttacatagttttcacagctgtattttgcttttccctcttttctaatacaccatataatctcttctactattacccccaatttacaaataagaaaacagattaaacgatctgccccaactcatgtacatggttacaaaatggcagaaatgggactaggacccagatctttgtgcatttcattctgacactcctactactacactacactacctcataaaggaaaagacatctcaaattttttaaaatctgcaaaaataagaaatagctcaagatatgatcctttagtttacagaaagacttatcacagtaagagtcctaaaaatcttgaaaattccttctgcataattcgacctagtctgtagccgaaaagagctcatatatcatttacaatttgacaaaaatcctagagaaagaatatttagaggtaaaggatttgggtcagtatcaaggcaatcagaaaagaaaagaaaacatcttgaaaattataatatgagccaatggagaaaaaaagcattgaagttaaaaactctgtggaagcgtatcaccatcaccccatacatggtgcagtgagtgctcctgtgaatagttataaggctgtttatgtaaggctcagtgtaagaaggacaattacaaagcctttttccagtttttcataagcacagatacagtcggaaagcaggctgcatttaagaccacgaccaagttctatactgggaattgtataagacttaggacagtatatatatacacacacacacatatatatattctagagaatatgtatacatatatatatacatattcttgagatggagtctcgctctgtcacccacgctagagtacagtggcgtgatctcagctcaccgcaacctccacctcactggctcaagcaattctcctgcctcagcctcccaagtagctgggattacaggcgcgtgccattgcacctggctaatttttctatttttagtagagacggggtttcactgtgttggcctggctggtctcgaactcctgacctcaggtgatccacctgcctcagcctcccaaagtgctgggattacaggcgtgagccaccacacccggcctcaaagcacagttgtcaagctggatcagaatcaataggaggatgcttattaaaaatgaagatttgaagtctcagtcaagatgcattaaatagaatgtctagggaatggtttgggaatctgcatttttaaacaagctctctaggtgataatacaacaatgaagtttaaaaaccactgacttcaagaagttattggacacttcagaatattaattattattttagtctcttacactgatgttcctaaatctgaagttttaggggtttgggtttctccccacaaacattgttcacttcgaatcaaaaaagaagcttcaggtgtttagtaattagagtaaaacacgtttcagctatggaggatggcgcttggcaagcaatgttcatttccacacatggaacccagctcatcaactacattgaggtcaagggggcactggatatgtctgtaactgatgtagatgagggtacatggaactctgcaaaaggcaaaagaagcccaaataaactgatgaaacaagtttttaaaactaagttataggtaaaataaataaaccagttcttgtaataaactgtatgtcctggccaattgaccctgcaacaaattaccattaatataacgaatggataaggcactgtgaatctaattttcagctaaagctgttttgtgagttcttaaaagccttcataggcaagatcagcttgtacaatgatgtctttaaacaaattatccttatataaagagatgcttataaaagttgtagactaaaactacctcacttttgtgctacacatttttgttaaattagcagcttagtttaatatactccaagaggcatgaaatgaaggtataatgtgatctttctgtatgttttaataccctgagtaataataaataatgacaatcgagaatagtgactgctactttatttcttggaaaagcattaaaattaacatgaaattttatttattaaaagcaaagctttttattaaaacttcaatgcttaaaaacatgaaacatcaaacagtatttattaaacattagtatttattaaacattaaaatacaattgtatttactgaacattcttactctttaaagtgaatgtgtaaaaaccacttttaaaagagatctacagataatgagtaactccagaaacaaaggaagatgaggaatgtgaactaaccaggagaagaacttgagatccttgacaattaactccttggtctctcaagatttctatctttacaaagaattctacatgtactatcgttctggcatagaatttccacacatttcacataaaatcccttgtctctaactaaagaaaacttttttcttagtagtgaaataaatgtgttgagtgtctactggtatgcatatatcaagaattttagagacactaaatttttagacatgtgataagaatcatctgactaaaataccttatttccttatcttgagggtcctatggagtcactattattactctaattttacatttgtgtaaactgtggctcagaggttaaatgacttaagaacgcaccagtaatgagatttgaccataagttttactttgaagctcatgcttttcccaataaaatatgctgacttccacaagtctatggatccaatgacacatttactgtgactgctttaaagagttaggtttgcaggcccagaactcaacattatctgtttatttctttattattagttttgtgccagggatttcaccaaagacatttataatgcaaaaactataattatttgatatctcttttgcatcagggtagagtttcaaaaatatgtattgagaacctactatgtgtcacactctaaggatacagtggttatccctaacaaggtccctaaccctcaagaagcttacatggtagtgcgggagaaaagacactaagcaagtaaacaaatacgtttcagggagcaccaatgtttctgaaaaagcagagtaatgggataaagggtgactgaagtgctggagtattttagatagcatggtcacagaaggcttctctgaggagatgatatcctcgctgaggcccaaatgatgagagaaaggtaggcaagctaagaggcaagaacatcctaggtgtgtccaaggaatagccatacaggccaatgtggctagcatggagtgaattcatggtaggacacaatacatagcaggacaggaagtaaggaaggtgagaaaggccatgtcatggaaatccacatccaaggaagggcgcacatacacagcaatacacgaaggactggcatgcaggtggccatggctgctgtcagacaggaaagatggcaatatgttggcatagcaggttcccagttcaacagctatgccagcatcttgcctcctctccagttccaagttacaggagaatactatgactcttcagtgttttacttttccaaaatttttcctttcacctgagggagggaaaacacactcattaattgaaagcgcacttatttctgatcataacaacatagtcttccttagagtgtccgcttttgaagatgtagttaggcacaggaggtttgtgggtagttccatttttttaatggtctttgatctaaaatgaacctcgagaatgtttatggactacttgtgaaaccacagggatgaaattgtgacaaaaattttattaaatcaataatgtctaaagttgatgacagttaattataggctattaccaccatatttatagtccacaaaatatcccagtgactctcagtacaattttatttttactctaataactttacttggtcaatttctgccactcagatgtatttaaacaataacaaactgtggctcagcagtgtgtagttagttcactgctttatgtgctcttaaaaataatgttatttttggatttttttaaagacattcttgctctgtcatccaggatacagtgcagtggtgcgaccatagctcactgcagcctcaatctcccaggctcaggtgaatcctcccaccctagcctctcaagcaactgggactacaggtgtgtgccatcactctttttttttttttttgtatttttagtagagacaaggtctcgctatgttgcccaggctggtctcaaacccttaaactcaagccatactcctgcctccacttcccaaagtgtttggattacaggcatgagccaccatgccctgccaaaaataatgctcttttgagccaaaaattcccagctagaaacttatttcacaagtacatttgcaaaagtaccactaagttctaggtccaaggatgttcactgcaacactgtttttaatagtaaaagattggagacaacttgaacactcatcagtatgattgatacaggctaaataaataatatagttatacaacagaatatttggtggtccttacaaaacagtaaggcataagaataatgacattatgtataacttttgtgcaagtgaaaatgtatacacagacacatacctggagggcatacatacatgttttttattaaaggataaatgagcaatttattattttaaataaaaaaattggataggattataaattatgtttgctttcctctttaatatgtctctattaaaaaactagtaagtaatacgtattatttacccaaaatggagtgtaaggtaacctataaaggtaaaacattttgttatatagtgctaccaaggtatagataaggaagaagcatactcttttaaatatgattctagtatcaattgcctttgccagaaacaaaagtccagcattacctaagcctggtactagatatacacatatgcagtcacccacgcatatacagtatgtggtgtctgttcttgtgagggtaggaacttatgagtgttctattgcacaaaagcctgtaacatcttgtcctgaggctaggtaacttgtggaagaggtactaattgacttcctaggatacaattcaacttaattgcatgatctattaatgtaagggtatttaggaatttggggatcattaagtacagagcattgaatcaaaattaatggcaaatgcaaaacaggttaggtaacaaaattctgaattgagaagatttaactgaataaagcttctccaataaactcattattttaaaaaatattactaatatctgatattcataattaagaggcaggtacaagctgcatcattttagaaggtatatggtacatatttgaaaacagtaatttcttgtgacttttttcagttccattttgcacataaaaatttcagattcaaggccaggcatggtcttgagtacatctcagaacttttgaaggccaaggtggaaggatcacttgaggccaggagatcaagatcagccagagaaatatagcaagattccatctctactaaaaataaaaataaattagccagctgtggtggcatgcacctgtagtcctagctacttgggagaatgagacatgaggattgcttgagcacaggagtttgaggctgtagtactgtactccagcatggatgacagagcgaggtttttctcaaaaaaaaattcagattcattttgtaaagaaaattgaataacagcaactatctgatttaccagtcagatgtagcagatacctgaatatttaaaaggaggaagaaaacttactttttaggttatcaaataatttctcaatgtgtaattgaaaagtctagaaaaaaactgtactcttttgaagaagctgttgctgttgaaactgaggtgctttctttaatttctctaatatatcctgagaatcatggctttcaccaggttactggtaaaacccacaccctcaccacatataccttaaacaaatttcttgcaaaactctaacctaaccaggaattgttacaatgggaaaacaaatcaggtatatatatatatacctgattataggccttagcagttaaggttaaaccttgaaaaatgctgacaaaaaaatgccctggagagaatgcagggcccatttataatttttttcctaaaagaaaaaattttcttttacatttcaaacttttagtattgtaactaacaaaataaagttcaaagtctaggattcttcaaattattctaactttaaattcatttaaaattaataaggtgactttacttctaaataactgatataaaagtattctggcagcaaatctagcatgttccagacatatgaagggcaagggggaattagctataccaaccccaattaatacacagacataaagaataagaactcaatcacagtaactgaaaaaaatggagtaactaacactcactgtggcttttcagagctgaaatacaatctacttaacgcctcatttttaaaaaagtgttttctaaaaaggggttggggtaggggttgattatgtataaaaagttagaatgtcctatttttcatgtacagtattatgaaaaactttgtggtccaatcaagaatataactgtaggaaaaaataacattcactgaatgtgttggtattgcctttgggaatagacaatttaataggatgtgctcaaagctactccctaaattgatagaagccatatgtgtctctgccctacatctgtggggagtggtttgcaggaagaaaggagtacaattatatatacatatattcaaaataaataaatacatatatatatattcaaatgaatgaataaatataatctcttataaattggcaaagacaacattatggcccctggaaggactcaaaacctatggagggttccatgtattaatgccattcattgtacacttgatcactatccatatcgcacaaaaaagtaccaatgagggaaaaaacaattacaatagaaaatattttatttatttgtgcttaaacagtcatctatagtattattgaggagaaatactgaaataattacagatacttttagagtaaaaaaaggcagcttataggaatggctaagaaaagaatttataaaatcaaagatttttgaagtgtctttacattagcaagcctgtatatgtatacatgtgtgtgtatacacatatatagcatacgtaattttaatttttatataatcttttttatggaagaacaccaccaaagacagaatataactcttttaaatttaggaatactaataaaatacaactgaatatctctatcaggtatcagaaacgatccccagggcaactacaaagtatagaaaaactgacaaaaaggagttaggtttttattctctgccccaccagccctgtcttgcctgctggaagacctcacactctcttccctctgcctatccaacttcccacaccccccaatatacagacacaccacagtacctacaccaggcttgtcctcccacaaaatgccctatttcccaaaattccactccactacccttctaaattcccatttcctcttcacatatgttgtctataggaatgaggaagaggaaatctacccctacattataaggattcaagacaaactgcaaattgttaataagcttaagcatccaaaaggatcccaatttttaggagacaagtattatactaaactagcaattagtagaaaatatggaagatattttgaattcagagctctctattctataaccccttgcttaaaatgggccaaaattaaagcatttcctattttccaaaattcataaaaacccactgaaaagggaaggtgggggatgaggggagaagtaactatcttttttgagtaagcagtatatacttttacatttttcccatacttaatcctcagaaaactggcagtggtagatattattatcgcctatttataattgactaagctgaggctgaaaaagtttatctagagtaaacatctcaaagtcatcaacctactaataattccattaatttaacatttgttggtcttctattatatgccaggcatcgtgctgaagacagggcctttacctataatgggtttccaagtgggaggtgacagtatatattttcacataatttggtaaatcctatcatcaaattatacactagctataataagaacaaatacagcatcatgatggattacaatgatggctgaattctccctgaatccaaatcgtggccatgtgactttgcagtacatattctgactctggagttagctgtataatttgtcttggtcagcttgtgatgtgagcaagacatgatgcaaacagagcttaaaaagcactggtgagactaggcctgcctgctctcttgatcctttgtcatcatgagcgtatacccagactactctactaaagaataaggcgcaaagaacatggccaagtctccctagttatccccccagccaaggcccatctagatcagccaaaagcaagccaaccccaacatgtgagcaaagccaaccaaaattaatagagctgcttaggtgacccaccccagatgtgtaagcagtaaacactgctgaacttatttgaggatttttagttgtttgctatgcagtattattgtagaaaataactgatataagtataatgattaaaaccacatgctttggatttaggctaaccaggtcaaaattgtcattagaacagcaaataggccatgtgaattcaagtcacccatttcatcacatgcacaacaacaaagtcaccaactccttattctgcactgtgctggtaaatgataggatttcaatgaacatttatggataaatgagtaaacattgattaactgttttgctagactataggttccttaagagtaggaggaaagccttacttatctctgtgcacccagcatacactgtgatgaaagagacttatagagagatcagtcagtactggttacatgagaaagtactatgaatttggattaccttattaagatggatgggaaaccactaaagggctgtaaggaagccaaacaacaagatttgtgtttgacaagattactttggctgctctataggggtaaacggacaggaggggccagaacggatgcacagaaaccatctaggagccaccaaggctgtctgtgcagagatggtgtaaccttggattagaaaaagaaagcacacagattcaagatatatttggaaagcagaagagaaaaatttgcttgaggcttgagggcctaagaaaatggaagaaccaagaaaaaaaacagttttctgctctatgctcctacatgagcagtggtgactttcactgatagggagctcaaaaacacaacagatactttaaaaatgcagactcagagagactctgagttaatcctagtctaaggccaccactgggaacatctattcaaagaatctgtgacatcaatttatgtgaagaatgatattccttgaacactaaatcattccctgttgcactagaaaacttcatttgccttatgtagctgaagtgacctgaaggaaggctctgctgaacctttgctagatggcaaaatacagccccactgtggaaacttcttgaactatattgaaccttctaaggaaactaagcctaagaaggaaagagtatacatgcctaatttaaaatcagctttagagactgaggatgagttctttcctgcttcacgaattttccatgaatctaaaaattgaactagactttagaacatgtaccttatcacattagttaattcaaatgtttattctctactagagccatttctgtctttaagtatgagccattctactttctctggatttcatggccatggactgccacccaaatcctagtcagtcacctaaaaaatgtgtgctattgacattaaaggaacgagggtggtgaaagtagggagagatccatgcaaacccatcaacacttctggaaagaaaccaaagcattctgaaagtgggtgaacaacgttttcatgtgtggaaatgtagagaatttgggaccattatgagtgacacgaggagctcagtgacttaccagtatttatatggtgcttcctaaggcccaggcaagcactttttcatcaaaaaaagacatttcaaaaggactttttcattactgtatagccaccacccataaagatttagtacagtgctgctttagtttgaaaaatggtgcccctccaaaatttatgttaagacaatccccaacgcaacaggattaagaggcgtggcctctgaaaagtgattaggtcatgaggattccaccctcgtggatgagattcgaatccttataaaagggctggaggttgaagggagcactctcttgcccttccaccttctggccatgtgactacacagtgtccatcctctcagagagaggcagcaaaaaggcaccatctttgaagtgaagacctggctctcagcaaacacaaaacctgccagtgccttgatctccctgcctccagtactgtgaaaaataaatttctcttatttataaattacctagcctgtggtattttgttatagcagcacaaatggactatgacatgtgcatatctttaaaaaataaaatatttgtaatggttgatttacacattaaattcatattctatatcctccaaagtctgaaccaaaggtaagatgtatttagaatacattgtcaagagctgtacatctattcttttattaaatcctaactccaaactgaaaagctgttgaagaatttttttccattttatactatatagctgagaaaactaaacctcagaaaggttaagtcattagttcacaatcacagtgctagttaatgttagaatctgaattcagcatgtcttccctcagagtctgcattctatctgtgcccccaaactaacttccaacattaccacccttattttctacggaccaatggggcttttctttggggctggaatcatctcctcactaccccctggcatactattcccactttgttcctgccatttcttctgcccctgaaatattcctcaaatggtcattctgcttcatcattccaaaaggaagcattctgagctcaaaacaaaacaaaactaaacaatgattcaccatgttgattcacaacaaaactataaatgactccgttttctggtttgtcaataagcttcagaatactgtcgaaacacataaaatacaaaacatttatattatcaggctaatggttgcctgtgacccaactaagaccaaagtcagacataatgcacacatttcagaggaatttcccaactaatccaaaagtcaagggcttccagatatttccatcacccacaagtggcattcccttagaatgctaagtcttgagccctttccaagtgttgttccctaactctgtaacactccctgaacatgccgcttggtctacctggcaaaccagaattaatcctttaagacaatggttaggtagtgcccccttctttgcttgtgtctctccacttccaccacacaccttgatgtagagtccctattctcactgtacacatacctctcccactagcttttgagctctttgtgggcatggacatgtcttcttaaactttttatcccaaggcccaccaaagaatctgcacatacattaagcccaataaatgctgaatgggcacgctcatgacctacagatattgacactgtgattgaaaaacttctggattcaggaatggggtgtgtttatttttataatatccagccaaatatcaaaggtctagagaagcttctacaggcatatcttggagatattgtgggtctgttccagaccaccacaataaagtgaatatcacaatacagcaagtgacacaaatttgctttccagtgcatatagaagttatattacactgtagtctataaactgtgcactagcattatgtctaaataaaagtacatatcttatttttaaaatattgctaaaaaacgctaatgatcagctgagcctccagcaagttgtaacctttttactggtggaaggtcttatcttgatcttgatggctactggctgatcatacagtggtgtcagctgaaggctggggcgactctggcaattttttttttctcacttttttttttaacatttattttaagctcaggagtatatgtgcagctttgttatattggtaaacttgtgtcatgggggtttgttgtacatattatttagtcaccaaagtattaagcctcgtactcattagttatgtttcctgatcttctccctcctcccaaccttcaccctcttgtaagccccagtgtctgttgttcccttctatgtgtccatgtgttctcatcatttagctcccacttataagtgaaaatacctggtatttggttttctgttcatgtgtcagtttgctaaggataaatggcctccagctccatccatgttcctacgtgttcttttttatggctacatagtattccaggatttagctgtatcactttttctttatccagtctatcagtgatgtacattttggttaattccatgtctttgttattgtgaatagtgccacaatgaacatacacgtgcatgtgtctttatgacagaatgacttatattcctttataacagcatggtttatattcctttatgacagaatgatttatatcctagtaatgggattgctgggttgaatggtatttctgtttttaggtttttgaggtatctgtcttccacaatggttgaacaaatttacatttctaccaacagtgaataagcattcctttttctccacaaccttgccagcatctgctatttcttgaatttttaataaaagccattctgactggtgtgagacagtatctcactgttttgatttgcatttctctaatgatcagtgatgttcagctttttttcatatgcctgttggctgtgtgtatgtctccttttgaaaagtgtctgttcacatcattcacccactttttttttttgttacagggcacatgtgaaggatgcacaggtttgttatgtaaatgtgtgtcgtggtggtttgctgcacctatcaacccatcttctaagtattaagcttagcatgcattagctatttttcctgatggctccctcctcctgacctcaccttgacagcccccagtgtgtgttgttcccctccatttccatgcattctccttgttcagctcccatttataagatcatgtggtgtttggttttctgttcctgcgttactttgctgaggataatggcttccagctccatccatgtccctgcaaaggacaggaactcattcctttttatcctgtgcccactttttaatggggtttttttttcttgtaaattggtttaagtttctcatagatgctggatattacacctttctcagaagcatagtttgcaaaatttttctccctttctgtaggttgtctgtttactctgttgatagtttcttttgctgcacagaaactctttaattagatcccatttgccaatttttgcttttgttgaaattgcttttggtgtcttcatcataaaatctttgcctatgtccagaatggaattgcttaggttgtcttacagggtttttataggtttgggttttacatttagtctttaatccatctttaggtgatttctgtatatggtataaggaaggggtccagtttcagtcttctgcatatggctagccagttatcccagcaccatttattgaatatggagtcctttccccattgcttattcttgtcaatttcatcaaaggtcagatagttgtaggtgcaaggccttatttctgggctctctattctgttccaatggtttatgtgtctgtttttgtaccagcaccatgctgttttggttattatagccctagagtatggtctgaagtcaggtagcatgatgccctgagctttgttcttttcgcttaggatcttcttgcgttttgggctcttttttggttccatatgaatttttacatagttttttttctagttctgtgaagaacgtcattggtcatttgataggaataacactgaatctataaattgctttgagcagtatggccattttgacaatattgattcttcctatccgttagcatggaatatttttccatttgtttctgttacctctgatttctttgaaaagtgttttgtagtcctccttgaagagagctttcaccaccctggttagctgtattcctaggtactttattcttttgtagcaattgtgaacgggattgtgctcttgatttggctcttggccaaactggtataaagcatttctagtttagttactgtcgttggtctaaagtaatgctagtgatttttgtaccctgattttgtatccttggactctgaagttgtttatcagctgaaggagcttttgaaccaagaatatgaggttttctagatttaggatcatgttgtctgcaaacagaaatagtttgacttcctctcttcctatttggatgccctttatttctcttgcctattgctctggacaggacatccaatactatgttgaataggaggtgtgagagacagcatccttgtcttgtgtccgttttcaagagagatggttccagcttttgcccactcagtatgatgttggctgtgggtttgctatagatggctctcattattttgaggtgtgttccttcaatacctagtttattgaaagattttaacatgcaggggtgttgaattttatcaaaagccttttctgtatctactgagataatcatatggtttttgtctttagctccatttatgtgatgaatcacatttattgaattgtgtatgttgaaccaacttgtataccagggataaagcctacttgattgtggtggataagctttttgatgtgctgctggatttggtttaccagtattttgttgaggatttttgcactgatattcatcaaggatactggcctcaagtttttttgttgttgttgtgtctctgccaggttttgttatcagaatgatgttggcctcataggatgagttagggaggagtccctcctcaatttttgcaatagtttcagtaggaatggtattagctcttctttgtacatatggtagaatttggctctagttctgtttggttggtaggctatttattactaattcaattttggagctcattattggtctgttcggggtttcaatttcttcttggctcagtcttgggaggatgtatgtctccaggaatttatccatttctttgagattttccagtttatgtgcataatgttctctgatggttatctgtatttctgtagggtcagcagtaatatcctctttgacatttctaattgtgtttatttggatcttctagtttttcttattagtctagctagcagtctacctattttagtaattttttcaaaaacccactcctgaattcattgatattttgaatgttttttttcatgtctcaatctcagttcagctctgattttgggtatttcttgtcttctgctaactttgaggtttgtttgctattggttctctagtccttttggttgtgatgtcagcttgttaaactgaggtatttctaacttttgatgtgagcatttagtgctataaatttcctgcttaacactgccttagctgtgtcccacagattctggtatgttgcatctttttttttttctcacatgctcagctgtccaaggttggcttccccactgcacactcgagtggtatgttgcatctttgttctcaatagtttcaaagaacttgatttctgccttaattttactatttacccaaaagtcattcaggagtaggttattctatttccatttaaatatatggttttaagtggatttcttagtcttgttttctaatttgattgtggtgtggtctgagagggtggttattataatgagcctagtactcattatacagcatttggtgaggaatgttttgtgtccgattatgtcattgattttagagtatgtaccatgtggcagtgagaataatgtatactctgttgcttttggatggagatgtctgcagatgtctatcaggtacatctggtccagtgctgagttcaggtcctgaatatccttgttaattttctgccttgatgatctgtctaatattgtcagtgtggtgttgaagtctctcactattattttgtggttatctaagtctcttcataggtctctaagaacttgctttatgaatctggatgctcctctgttgggtgcatatatatttagattagttaggtcttcttgttgaattgaagcctttaccattatgtgatatcctttttgtaatctttgctggtttaaagtctcttttgtctgaaattaggatttttctgttttctgtttgcttggtagatttttctctggccctttattttgggcctatgggtctcactgcatgtgagatgggtctcttgaagacaacgtaccaatgagtcttggttcctaatccagcttgccactatgtgcctcttaattggggcatttcacccattttttaaaatcttttttgtgttaaatatttcttataattccttttattttttacttttaacttcagaagtacacgggcaggtttgttacataggtaaacttgtatcacgggggtttgttgtacagattatttcatcacaccggtattaagctagtattcattagttatttttcctgatcctctattttcgcataccctccatcctccagtaggtccaagtgtgacttgttcccctctatgtgtccatgtgttctcaccattcagctccaatttataagtgagaatatgcagtatttggttttctgttcttgtgttagtttgctaaaaataatggtctcagctccatccacatttttgcaaaggacatgatttcattcttttttatggctgcacagtattccatggtgtatatgtacattttctctatcgagtctattattgatggacatttaggttgattccatgtctttgctattgcgaatagtgctgcaatgaacatacatatgcctgtgtctttatgacagaattatttatcttccttccagtatatacctggtaatgggattgctgggtcaaatggtatttggttttaggtctttgaggaatcaccacactctcttccacaatggttgaactaatttatacacccatcaacagtgtatatgcatccctttgtctccacaaccttgccagcatctgttatttttttgacattttaataatagtcattctgattgagaattatatctcactgtggttttgatttgcatttttctaatgatcagtgatgttcagcatttttcatgattgtgggctatatgtatgtctcgttttgaaaagtgtttgttcatgtcctttgcccactttttaatggggttgtttttttcttgcaaatttgtttaagttccttatagatgctggatattagaccgctgtcaaatgcatagtttacagaaattttctcccattgtgtaggttgtctgtttactctgttgatagtttcttgtgctgtgcagaagctctttcattttattagatcccatctgtgaattttttattttgttgcaactgcttttggcatgaaatctttgcccatgcctatgtcctgaatggtactgcctaggttgtcttccggggtttttacagtttttgattttacatttaatccatcttaacttttctatatggtataaggaggggggtccagttttaaccttctgcaaacgcatttagcccatttacattcaaggttagtatttatatgtgtgggtttgatcctgtcattatgatgttagctggttatcatgcagacttgtttgtgtggttgctttatagcgtcactggtctgtgtacttccgtgtgttttttagtggctgataactctttttccatatttagagcttccttgagaagctcttgtaaggcaggttgggaggtaatgaattccatcagcatttgcttgattggaaaggatcttatttctcctttgcttatgaagactcgtttgacaagatatgaaattctgggttagaatttttttaggaatgttgaatattggtccccaatctcttttggtttgtagggtttctgctgagagatctgctcttagtgtgataggcttccctatgtaggtgacctgacctttctttctagctgcctttaacatttgctctttcattttgaccttggagaatctgataattatgtgtcttggggatgatcttcttgtgaagtaccttactagggttctctgcacttcctgaatttgaatgttggcttccctacctaggttggaagtgtttccatggatgatatcctgaaatacattttacaagttgctcatactctcctcatctctttccaatcagggacatcaatgggtcacagatttggtctctttacagaactccatatttttcagaggttttgttcattcatttccattctttattctctattcttgtctgactgtcttatttcagaaagccagtcttcaagctctgattctttcctcctcttgttctgctctgctattaataattgtgactgcaccatgaaattcttgtagtgtgtttttcagctctattagggtggttatgttcttttctacactggccattgtgtctgtcagctcctgcactgttttactgtgattcttagcttccttggattgggtttcaatgtgccctgaagcccagtgatctttgttcctatccatattttgaattttatttctgtcatttcagctatctcagcccagttcagaacacttgcagttgtttataggaaagaaggtactctggcttttgagttgtcagtgctcttctgctggttctttctcatttttatgagctggtgcttcttcaatctttgaagttgctgactgttggatgtttttattttccttttatcttacttgatgaccttgagagtttgtggtataaggtggatttagtctactggtttgtttctggaaggttttagggggccaacactcagctcccaacctcaggactgtgtgctcatagtgcagtggcagcagcattcttcctcatttgcatatgccagcagcagtgacagcgcagcagggtacatgctcatcagctgtgacagggtaccagtgggttactgggtgcctgcctccgtgcaggtgttcaccacagtggtggagacagcagggttccagaggttggggacccctgctggtgattattacacatgattgtgctgtcttggggatgcataggggcagggtgctggtgggtacaggtctgtatgcattctctgtgaactgcatgaaggggtggtttctcagggtaggggagggtctgctgttctctgtgcctagtttcacttctgtgtcagtgttggtgcaaggatgtggtgctagtgggagtggggctgattttccatgggtccaccaacactctgactgcaatggtggtctggcaggggaagaaagagcagagtgcaaccccactgcggcagtggcagaggagggtgcacgcacacaggcacactgacagaacaaaggtggcaaaacctgctcccatacacacgtgctggcaaagcaatgtgggaggttgctttgggccctggggaagtggctgtgcggggagggtgtgggtgggctggtgtgtggctgtgggggttgctctgctggagctctccactagtcaggcagggtccaccagtgcagaagctatgatgtgggcccccagggtacccgaggctgccctgcaagtaggtgtggccaggctgggacctaggagaggccagcacaccaagtggtgctcagatcagactggcgccatatggtgggtaagaccaccctgcagagttcaggtccaacagttcccctagggctaaggtctcctatgggagcaagtcgagcctagggagatgggcttccctggcagtgctctactacagacactcccacaccaagagctctgggctccacttcagctggcatgaggctcctaccacttctctaagcagccagaggcccgtggtgaaagtggcttgctccttgccagttcaactcaccagttcccctggagtctttaagggccaggaatgagtcccggtgcatggtaatcctgtgcagaattccaagcttcctcccacttcagcccagcttctgtgtcttccttccatctactctcggtgccttccctctgaatatctgttaggagtgtgcgccagtgtcttggtccatcagtggtagctgttcttcctgggtccatctggttggccatcttgctctctccctgcaatttcttaactaaaacagcattaatcaactctcctttaaagaaatagcatgggatgccatttagcattttgcccatagtaagatttccttcaaaactggagtcaatcttctcaaacactgcaactgctttatcaactaagtttatggaatattctaaatcctttattgtcattccaacaatattcacggcatcttcacaaggagttgttccacctcaagaaaccactttcttgatcacctataagaatcaactccttatctattaaagttttattatacgactgcagcaattcagtcacatcttcaggctccacttctaattcaaattttgctgttcacaccacatctgcagttacttattccactgaagtcttgaacgactcaaagtcatccataagggctggaataaactttttccaaactcctgttaatgttgatattttgaccctcccccatgaatcataaatgttcttaatgacatctagaatgataagtcatttccagacgactttctatttatgcaacccagatccaccagagaagtcactatctatggcatctatagccttataaaatgtagttcttaaatagcaacacttgaaagtcaaaattaaacattgatccatgggctacagcaacggtgttgtgttggcagccaggaaaacaacattcatctcctagtacatctccatcggagctcttgggtgatcaggtacattatcaatgagcagtagtattttaaaagaaatctttttttctgagcagctctcaacagtgggcttaaaatactcagtaaatgatgctgtaaacagatgtgctgtcatccagacacattgttgttccattgatagagcacaggcagagtcaacttagcataatatttaagggccctaggatttctagaatggtaaatgagcactggcttcaacttaaagttactggctgtattagcccctaacaaaagaatcaccttgtcctttgaaactttgaaaccacgtattgacttctcctctctagctatgaaattcctagatggcatcctcttccaatagaaggctgttttgtctacactgaaaatctgctgtttagtgcagccaccttcataaattatcttagctatatcttctagataacttattgcagcttctacacaagcacctgctgcttcaccatgcacttttacattaggctccttctcatgaagcaacctctgctagcttcaaacttttctcctgcagcttccttacctctaagacttgacagaattgaagagagttagggccttgttctggattaggctttggcgtaagggaaagttatggctggttggtctgatcttccatccagacccctaaaactttctcttttttttgtcaaataaatataatcctttattaaatgaaattttacaagaacagtttaacccctaaaactttctacatatcacaataaagctgttttgctttcttatcatttgtgtgttcaccggagtagcaattttaatttacttcaagaactttttctttatactaaaagcttgattatttggtacaagaggcccagctttcagcccatcttagtgttagagatgccttcctcattaagcttaatcatttctaccttttgagttaaagtgacagatgtgtgactttttcttctacttgaacacttaagaggccactgttgggttagtaactggcccaatttcaatatccttgtgtgtcaaagaatagggaggcccaaggagaggaagaagacagggaaacaggtggtcagtggcgtagtgagaacacacacatttgtcaattaagtcccctgtcttatatgggtatggttcatggcacccaaaacaactgcaatagtaacatcaaagattacagatcaccatagcagatataataataataaaaataaagtatgaaatactgtgagaattaacaaaatgcgatagagatacccagtgagcacatgctgttgggaaaatggttctgataaatttactggatgcaaggttgccacaaacttgcaatttgtaaaaagcacaatatctgtgaagtgcaataaagtgaagcacaataaaacaaagtgtgcctgttatgtttattcacagctaagcctattttcaaggaagatgatggtcagcactcaccagaaaggctgtgctaatatagctctcttgctatgcaaaccattgtggcagggtatgctaaattctacacaggcagcagaaccttctgtagaaactatgggaggatgtgaaacagaaaagaaagcaaaaaatctcaagtggtgaatccacaaaaaaaattaaggtagcacaaatcaaaaatgagaaaccaagtggagactaggggccctgtggaaataacattatgatgacaaattcttctgtgtctaaacctttgtggatttctggctaggattatttctaatagcaatactttgtgttctcattcctttctccttttcatctactcaaaaatagtacatcaaattattaagcaaagaataaagttaaaaatatgttgttttttaaatctaataaacaagctatttgacaattcaggaacatgaagttgaccattatcaatgtaattacattaaccttgtgccaactgagtctcctcctccttccctaatttctctcttcatagcaatcagagctttccctagtatttttttagtgtgtgacctacatctgagtttcccaatttgctttggtggagggaatcaaaaagtcagtttctacatccaataaaatctaccgctgagattttggattgatataaaactgagaggaagaaaaaagtggaggtggttttgtggctgccttggagaggttcaattaatatcttggcagagattcccagctatcctggaagttttccctaccttgggagtcttggtaaaatgctatacaggtaattcccctcagaggctggactggagaggtgatttaagccaactgggagtcaactacgaaccttacattggagaataaagtcaaacagctataaatatataaggtctccaccccagatgaatcaaagtcatcccacccctcttaagtgtcttcataataattctgtgatgtggtggtttagagtacaggctgaatgacagaagatatattctcatctcagcccttatacatacttgcacaatgtataataaccaaattacttaatttacctgagtcttgcttttctatctaccaaatcgggaaaataatacctacttcatagggttgtgagaataaaatgatgtaagaattaaacaaaataatgtacgtacgagtttgccacagcagttagcatctagcagatcttcaatacaacctaaaatgcaatctattttatccttttccattcttctgaatgataaaagtcatcaaataaatgataatgatgataaatatgatcattttggactggatgtgtatgtctccccaaaatcaacattttgaagccctaaccccaagtataactgtatttacagatggggcctctaaggaagtgattagggttaaataagctcataagggtgggaccctggctctaataagattggtggccttataagaagagacaccagagagcttctgctctctctccttccacatgcacacactgaggataggcaacgtgaggacatagtaagaaagtggtcatctgcaagccaggacaggagaaaccaaatcagctggcaccttgctttaggtgccatgaggaaataaattaatgttgcttaagccactttggaaccatgagaaaataaattaatgttgcttaagccacccagtttatactattttgtgacagcattccaaacatacaaatataatgatgatgatgacaaacgccttattccaacaaaggaatagactagataaggaatgataaattatatttactagatgtttgttttttgtttcaactttcccttgcaggtcactttggtgttgctgatgaaggcacattagcaaactgggcccaatcactgtacatttttgcagaggctattgttctaattaaaatctaatgccctgagccactaatgatgacaggacagttttcagatccaagaccactaaggctccaagaagagctagatattagaggaagtttcaggaagaaatatggtctgactacattaaggagccgagtcaaagtcagagtgcacaggttacaagtaatctagggttgggagtggagggatggacagtctggaggagaaaacaaaagttgtaacaacaacaacaacagtgacagctgtcagtgtttctgctctatgcaggcattactgaattatttccaatcctccctgaagcactgcaaggtaagcatcttcattctcattttattctctttatatagaatgtacagaaatgatactttgtaacccaaatctgatacagattttgattcataacccaaatctgattcatgaaagggaattctctgttgttcaaaaacaaaataataccaagttttttcatttgtacctgctccagttgtgctcccctttcagtaaatgtatctccaaagtcccacctagagataaaatatcaatacatgttaaacaagaattaaagtaaaagtgtgcatttttagatagttcctctaaacagctaagctgctctggaaatacctcttaaagtttataaatcatttccctaaaaacacccacgagcagctcaaataactcaagaaacaggagagaggaaacaagaagactgaaagaagacttgaaaacctaaaagccccaagtccaacttcagcgaagagaagtaaagtccaaacaacaatgtgaattggcagggtgttgacggggctgccctctgggccacagtagcaatctcatactcaaattgtcatcactagccttttatgttaatctttctaccagcatttggtaatctgatataatcacaaggaaaaagtgcttattcccccatacggtgaggaagtccctgccctttggaattttgtctgccatagaactgaacatattatcacaaatctgtttttcttacagtgaagagccatttatatattcttaattagtttgtttctgcctgtattgagaggaattatcttttaccaagaagcccaaaagaaaaactatttcatttcctcatgacagacattaacacatggcattctaagacaaataaacatgttacacttttacaacagaaatagagaaaaaatcctttcctaattaatttataattagttttctcttctggagctctaacttgtattggactttgagtaagaaaaaaaaaatccttaaaaagtaaaagttcaactttggttctatcaggtttgatatccagaagaaaatgcaaacttccattgattacactgcaaaacatctactactctaaggacaatggctgtttaaacgcctgaaataaagaatcaagagtggaccacacttgaagaagctaacaggtagtaaggcacttttcaaacacaatgggatggttaacataaaattaagaatgcatagatttcataactattgctggtaaaaagaaaatgtaaacaaaaaaatagaacttactgctcatttatttaaaacattaagtaacaaattatagaaatgtcatgtaatagtttcatatttaaaccttcacaatatttatttataaggggaaaatttatatttttagaaatactactctctttaaatgatgcccagaaatcctactaaaaatctactctgtaacttaattctacggagccattttagaaatattaaaaatatgaccacccctagttaaaatgtatactttcccccaaaaaacttcaattttaagaactacatttatttttgtacaagcaatatacacacacacagtaatcacttaaagtgtatgacgggatatcaatggatgaatctggagaaataggactctttatctccaatcacacattgtaagcatggatattggcctctcactagagttttattactcagattatttccaataaataaaatgtcttaaaaacaacataattgggatcaatttagtcccaatttccatgtcataaaatcagactccaatccttcttcaatacaagaagcttacttttcatttacctctaaattcacgatcagtgaccacagggttgagatggaattgctgagagtataagctgctgcctggggttggaagtaagcaatcttttcttctttctgggaatactaatgcttgctagaactctgccaaaacaggggttctcagcccttgctgcttcctagaaccctttcggcttttaaaacctactgatgcttggaccctgacaccacagcttaacaaatcagaatctctagaaatagggcctgagcattgttatgtttataaaagcttcccacagaattctaatgtgctgctggggaagagaccacacatatataaggctttgagatggatggatgttacatatagtcagcttattattgttgacatggtggtgaaccaacagggttgagtggaagaaaaatgagggtaagtttccatgatgaagtgataactactggagaaggctctatctatagatataagaagatggagtcaatagtcaggagactgtaagtcctggggatgacttcataaccagcaagctgtatgagttcaggcaagtcatctaagtccccggggtacagaactgagggagaaaggagggtggagggcccaccactcccaaccaaggcagccatacctgtatttgttttatatgttaggcttctgtgtgaaacttcacttcatgaaagagttctgtggccaaaaccagtttgaatacagccgatctagatgttctttaaggtctcttctgagataattttgcaacatcccataaatatctggaactggcccaccaggcctacatagaaaagaacttaagacaatcacaatgatgcttgctctccgcagttactcttcccactggtttattttgtgggcagaaggcttttatccaaggtccacctacaaacacagtggctcttccctctccttttatctgtcaggtactcaataactgctgtgatttttccctcttaacactgcacctgactacacccccttacaggtcaattctgattacctgtaaagtaaatgtcaactcacattgagattacagagtacatttgaggctctaaaacatttttctggagacaaattttcactatggaataaagaggataaatgtgtgccagctctctgttgagtttactcatccaaatgaaccttccaccataggaggctgacttgcaggggatgacagaagcagattccccagtcctctgacttcccgtcagggccagcaaggaggagccctgacaggaaaccagaggataggaaaggagggaagctggtatacccattttctgggcttactcctggtggggctgccacagattgactgtgaccttcaactggaattctccattcttctcaaagtggctgtctccttgcaggttgcagtaattactccccccatcacatttatgccaactggtgaaaaccatcttggcttttatcagggttgctcacactctactctttgcttttaaatagttcctttattgaaccttccatgaattatcctaattttaatgagccattttctgatagactcctgatacctgacacatatttgttaatcaaggatttctacggaggagccaagatggccgaataggaacagctccggtctacagctcccagcgtgagcgacgcagaagacaggtgatttctgcatttccatctgagacctacagctgagggtcctgtctgttagaaggaaaactaacaaacagaaaggacatccacaccaaaaacccatctgtacatcaccatcatcaaagaccaaaagtacataaaaccacaaagatggggaaaaaacagaatcgaaaaactggaaactctaaaacgcagagcgcctctcctcctccaaaggaacacagttcctcaccaaaaacagaacaaagctggatggagaatgactttgacgagctgagagaagaaggcttcagacgatcaaattactctgagctatgggaggacattcaaaccaaaggcaaagaagttaaaaacttttaaaaaaatttagaagaatgtataactagaataaccaatacagagaagtgcttaaaggagctgatggagctgaaaaccaacgctcgagaactacgtgaagaatgcagaagcctcaggagccgatgccatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctcattggtgtacctgaaagtgatggggagaatggaaccaagttggaaaacactctgcaggatattatccaggagaacttccccaatctagcaaggcaggccaatgttcagattcaggaaatacagagaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaagtccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcaactctgcaccaagtggacctaatagacatctacagaactctccaccccaaatcaacagaatatacacttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaaatacatggaaactgaacaacctgctcctgaatgaccactgggtacataacgaattgaaggcagaaataaacatgttctttgaaaccaacgagaacaaagacacaacataccagaatctctgggacacattcaaagcactgtgtagagggcaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagaggcacaaaaaacccttcaaaaaatcaatgaatccaggagctggttttttgaaaggatcaacaaaactgatagaccgctagccagactaataaagaaaaaaagagagaagaatcaaatagacacaataaaaattgataaagaggatatcaccaccaatcccacagaaatacaaactaccatcagagaatactacaaacacttctacgcaaataaactagaaaatctagaagaaatggataaattccttgacacatacactctcccaagaccaaaccaggaagaagttgaatctctgaatagaccaataacaggagctgaaattgtgacaataatcaatagtttaccaaccaaaaagagtccaggaccagatggattcacagccgaattctaccagaggtacaaggaggaactggtaccattccttctgaaactattccaatcaatagaaaaagagggaatcctctctaactcattttatgaggccagcatcattctgataccaaagctgggcagagacacaaccaaaaaagagaattttagaccaatatccttgatgaacattgatgcaaaaatcctcaataaaatactggcaaaacgaatccagcagcacatcaaacagcttatccaccatgatcaagagggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaacaataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcagggtacaaaatcaatgtacaaaaatcacaagcattcttatacaccaacaacagaaaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagctcaatggaacagaacagagccctcagaaataacgccgcatatctacaactatctgatctttgataaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaaggttagacctaaaaccataaaaaccctagaagaaaacctaggcattaccattcaggacacaggcatgggcgaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatccaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatctcattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaacgaaacaccgcaaattctcactcataggtgggaattgaacaatgagatcacatggacacaggagggggaatatcacactctggggactgtggtggggtggggggagggaggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaggatttctacttctaggtatttaaagaaataacgagatgcacgcaaaatttcaggggtgttattaacgactttggacagatatatcacaatcaggactaataggaaaggatgctacctataccacctgctatgtgcccttagcttactggatcatcagcagtccaggagagggaggcggggaaacacaggatatgactgttttctcatcaatatggaaatatttcagtattttaacaaccagtgtggctaaactggctgacagtcaatcctacaaataataatccttatgcagaatgacataacagcaaacaaaactggaaaaaatatattttcaataataaattattatttatcataaaccataaaggttcatatcatagaatgcaatgaagcataaaaaaatgtcttggacaagtatttactcatttgtgaagatacaaactacttagcaaaaagcagagcagttacaaaatatcataggctgtacaatctcaattttatttaaatatgtatgtatacatatatttacatctttaagtaaatagactgaggaactatatcaaaatgctaatactaatgtttatgagtagtggaataataatttaattttcttctttacaaatgtatgttttccaaaatttctgccattaaactgatgtattttatagcaaagataacattactttttaaaaatggagcacagtaaaaaaaaagctgctacattttaaactgaatcttaaaaatcttttagttactgtgctaaagcattttcacttcttcagaacaaagatttactactttaccttgatatatcagggaatagagaacagagatgaacttgaagcagttcggcatcactgacctgacaaccaagtggagatggttgtcagataaaaaaataatgaatcactatgatacaagcaaaaccagaaatatctaaagatacaaaaatacagggaaaagacataaattttttttctggaaggaggtcatggaaagcttcacagaggaagtgatgactgagcaggattctgaaggctaaacaggagttcaaaaaccagatatggcaggatgaagcttttctaggaaagaaacacccccatgcaaatgttctcgagcatgaaacagccaggaactaaacagatttagctctgctttctttctcctaaaatagaaacttgcaaggatcttgactttgactggaaggaataagcatttatgaaaaacattctaagtgacaaaaattgagctagtattttgttttgtctttaatggaggaaatgagaaaactgaggctccggtaagtaagaaccctcttagatattcctggaatttacaccctgatgggtggttagttactttatctacatagtattctcatgtatatatgctattatcgtattctatcagttgttctcattacatagaaaggattaagataaattggtggtgttcaaggttttggatttacctactagcgcacttcctcattgccacaggagttaaatattaactcatgctgatacctgtccaacatgtatgtacatgtgtgggtgggtgggtttaggcgcaggtggaaatgaagtattgcaaaaatatctgcagtttggtgagcaattaatcaggaaataatgagtgctatactggaataatcaccttaaaagtaaaaccttcaatgaaagcaaatctttcagaagttcaatatgggaattaaattactttaaaattgtagaatgttctaaacttttgcatttattgttttgaaaatatttttcaatggtaggcattttcaatcatttattttattacaaggggttaattctgggattattttttgctacttctcaagttaactatgaaaaccataattctttttttatcttttggttgggtttaattatgacaatgtcagtaatatggtttagttgtgtccccacccaaatctcatcttgaatttccacatgttatgggaagaacttggtgggaggtaattgaatcatgggggcaggtctttcccatgctattcctgtgcttgtgaataggtctcacgagatctcacggttttaagaaggggagtttccctgcacaagctctcttctcttgtctgctgccacgtcagacttgcctttcaccttctgccatgattgtgaggcttccctagccatgtggaactgtaagtgcattaaacctctttcttttgtaaattgtccagtctcaggtatgtctttatcagcggcatgaaaacagacttatacaatcagtgaaggcataactgggaagttaagtatcattaacttggtaaggttattcatgtttcaattataaagaatttaccacttcagatgaactcacctagtttcctttttctcttttctttttttttatttcaatagcttttaaggtacgagtggtttttggtacatggatgaactgtatagtggtgaactatgagattttagtgcactgtcatcagagcagtatacactgcacccgatacgtattttttaaatctctcaccccccactgcctcccactccctcttgagcctccaaagtccattataccactctgtatgccactgtgtacacatagcttagttctcccttataagtgagaatatacaatatttggttttccatttctgagttatttcacttagaataacggcctcaaaatccatccacattgctgcaaaagacattatttcattcttttttatggctgagtagtattccatggtgtatatatattacactgaaaaatgtaattctttaatatgtctatgtgagccaaaatctacaaatggttaatgcagatattaggtcaagtgtcactctacagtctcctgaatagtacagaaatcaaatttatacccagtgcaattttttcaccattaagacattttatttggccgtgaatttatttggccaagacaataaattcagtttttcttcagcatgaaccaaattactttcttagatgcacattactttcctccagttagatctctgttttttgaatcccaggcatcctaaaagaatattttgttaattctactatagctcaatcttataccacttgacttcaatgggccactatgaaaaaggaagctgagttgagttcctttaaagtcgtaaaaagtaaattaacattgaccaagcactttgaggataaaataaaatgtcgagtaataattattcttaaaataaaaataaaatcacaagaagttgccattctataatttttttgtgatttttttttatctaatatcccccaaagtcaggaggcagtgtagatgtacgaatattgtctgtattttctttcaagtaaatgcaaagccaaacaaacaaacaaacaaaacacaaatgcacttttcacaccacgttttgctctccacaacttttaggccctaagtacatacaagcatgtatgaaaaaacaaatgcacttattttcacacattttgctcttcacaacttttaggccctaagtacatcatgcatgttttaaatgcatcaaagaggcactgcatttaaaagcagtgagacagaaatggaccagataggcttggtgtgatagtgaccacaattccaataactataaaggagaggagaggtggactacatcctctaagcagactctactgagcttcaacactatctgtgctacctaaaataaccaagtgttggaaatcagttcttttattctatcatcaaaaagcatgattcagattgacaatggaaatttgatttatataattattaacaattttaaaaactttaaatagtagatctctcaaaagacaaaatccttggtgcatctagtagtgagaacttaattctaagaatttagaagaacctagtgatttccttgctggaaattataacccacggttaagcctgaggttggatgcccacccaccctgcacccccattatttctgcctactaataagcctttgtactgtgtggcctttccttaaagcacttttttttttttttttttttttacattttcaagtgagtacatagtatgtgtacttgcgggttggggcacctgaagacgaagtgagaagcattgttgagacaacatatcagaaaattcttgcctctagacaatcacttaggggcttgacttctggagaaaaatggcagtttgtcaaatccttgacacacttttaatttagtaattttattagcataatatgcctactagcaaaagaagaaacggaattgtttaaattttccctcattctgataatgaatgtcaaacatttttttaaaacattttaaaggatgagccaacaactttaaaataaattaaaacaccattaatttttagtaggtctatttaaataataattttgatttttgcatactattatttatttagtcttttctgtatcttgcagggtattcctaaatttataatctagtgtccaaagatttaatgaaagctcattgcttataacaatctgagaaaaataatattaacagtataaaggcagaacacagctggctaatttaagtgaatacaatttttaaaagcatttactccattgggactcataattacagtattttgccagtaaatctgtaaacatttcatatcatatgtattaaaagatcatgcttctgaattagtaactcttaaaaggtaaaattaaatattcataaatttcaataatttgaaacaccgcagtttgaaattaattgataaaagtatccccaagtccaggaagataataaattgctatcttctgtgttactgaaatataatttgtattattcctcaattagtaacccctacaattttaactgtggtgataaagtgttctacaatatgcaaggtggcaatttcaaaaccttcccctaaaaccagtattctcaagtcttttaaactcataactaaccaagcagaaaactctcatataaaaagtccagcagagctatgagtggttagacaggttaacgccaacctacagaggaatggaacagaaaatacacatcaaaatcattcagggatcaagggcagcaaactcttgaaatggttagagaaatcatggtgtggcatatttctcttaggcaagcagggtcatttctgagttggtccttctcagtaacccaaatgaatgaatgctcttttaaagtgcccattaactgaggtgcatttttctggctgtttttataaagtgcatgccataacaggtacttgtttggacaaagataaacatcgctttgtgttcacatgcaagtatggcttgtcacttggcactttgtgaattacttctcaaaaagaagtcctactttcagcagttcttgaggaaacagacaagggatctccctacagccactgattttaggaggtagggattaaaagtgtcaggaacagagcatctatttttgctcatgttttaattggaagtatagttaccactcaagccaactggaagcagaaaagccttcaagataatacattagaagaaaagttaagagggacactgaagatcataatccaattgaagaaagaaccattgagtcataggatatgaaaatttggatggaacctttattaaactagacgggatagtctaatagcttcatttaaccaattcagaaaagtataaaaacaagtcttcagtgagacctcttaccctacaagaaatacaaaatctataataaagatcaagtaataaaatagggcttgcagttcctaaccattcacagtggacatgctcccaacacctgcaatatacatacatttttactttctgtgtttaatgctgtttctacaaattctgccacgtgtatatgatcatccggccatgcagtaaaaaagcatcactctaaagtggtatggtctatattggaaagcaagtgttactccagcacctaagtttctaaatacttgaatatttttgcctcccaccagaactgactataaatataattattaaccatcccagacaaactataaagactcaaataaaagtagactcaaaggataaacatattgcatattgaagaatgctactagaatgaatatgtcatcctatagtttggattaatagggctcaaactatgaaatgtgtcatgtcatttcagaaaaagcaaaaaagtttgaatgtagagagaaaggagtaggagttcatatagccactagactcacattttttacatgaaccattgtaggatatgcattttacatcatgacctggtacacaatacatacataactaaaacaaaacttttacaaagcaagacttaccgctatgtgcaatgcactatgatatttctctatttctatttaacttcttaagtaatgctcatggtgacccacaaaactgatttcatgatacactaatgaatcagatccacattttgaaaaacattataccagaagactatcaaatcttcttgcccatggcatattattcataaatcccagcattcttcccagcaagttcagctaagcttcagaacccatttcaaacaagcattccaggcagcgagtatcaactatagttgggacacagtcaccacctaagttttaagaggacaaagtgcagggacagagtagctatttttattattttgcactgtttgtacccccagtgcttgcagagcatccagaacagagcgggcactcaaataaccactaagaggtgaatcagtaaacgaccactaagaagatcagagggtaagcttcggtttctgaaggccctctgtagctccttgcactccatcttttggctactttgctatctttaaatataaagctttcaaaattcaatcactttgagtactgtatgtaccgtccctgctctccaaactccaccttttaataacagttacctgtactaggctacttgatggtgcctctgttattttcaaaaacaattagtttacacttaaggaattaccaaaaaagattacaaatcatgatagagtcccttgataactggaaagaaggacctgccaaaacatggactggatattagtgcatgtattttcttatttcaacccttcaacaatctatttagtttcatatcatcaacccattttactggtgggaaaccaaacacttggaaaaaagaagtgaggtcacacaattagtaaatgcttggcagagccaggattttaaactaggtatttcattgctctttattatacctcagctgctcttaaaaatggcatttaaattacaaagaaacaatgaccagaagcctcaaacccatttgaagtgtgtgaattgttaacaagttatcgtgttggaaaaataaaaccctataacttagtaatatacttcatcacataactttactttttctttgccaaatctttgtgagttattcactgctgggtatgtttttcttggcagctgttaatcttggctccgacataagttcttactgtagagtaattcagatacgttaagtcctctattacacagagaaaaaacaagactctctctcgtgtgtatgcgtgtgtgtgtgtgtgtgtgtgtgtttatattgctcatgtccaagaggaaataaaaaatggaaacaatataaattgggggtgtgtgcatcgggcagttaaaagactttgaaggcagaatcaacaattttggccttttggctctcagcagaagtagtgtaaggaaatggagcggaaaagaacagtacgggtcaggtttaactcacatgcacccccacacaagtgtacgctgcttgacgtagtcacaaaacctgcaatgtgtaatttgcccaatcatgaccatgagtcactgtaaaagttactaagaaggttgttcaaaaaaagcatatttttgttataactttagttctcaaccaggaacaatttagggaacatttggcaatgtctggagacatttttggctgacactactgggtaaaagacagggatgctgctaaacatcccacaatgcacaggacagccccccataacaagacattatatgggcaaaatgtcagtagtaccaaggttgagaaaccctggttttcagtgcaataatatttcgtggacaacacaactactatactccagctgcctctctgatcctgtctcctcatctgtaaaataaagatgattatagtgcctcttcattgtgttgttgtgaggattgagtctgatttatgtaaagcatttaaaactacgcctatgacataagtaggtgctaaataaatgtcactcttatcaccaccagcatcatcatcatcaaagcttaccaccatgcggcatgaccctttattaggtgaattctcggggtgaaagaggattctgtgttaaaataaagttggaaaatggtaggttaaaatcagacaagtttctttgttgtgtaaatgcttggaatctctaataagcaaaaaatataggacatggagaatttcacattgatctgaccaaagaatcctatgcagaatcttgcaggactgaacacttttagggaaaggccggtgtggtgaaagggcatatactgagactctataaacaggattcagctcttgagtctatcacttatctgccatgaagctgggtaaggcccttgactttccttggcctcagtgatcaccaacgcaaaaaaaaaaaaaagcccttccagatcagaaagtctcagcttctctgatgctcctggttgtagcatatcactgcagacctcaaagacatgcactgtcagatgtcaaggacaccagggtcaagcaaaatgaagagctatgacaattcccaggataattatgctccccaaattcctgttactaaggaagctcaaatatccaatgtgggaaatcaagaggaacatgatataaaaactagccttatctgttgtgtttttgcaaatgcagtctaactttttaaacagaaagcaaaactagcaaagaacaatatggtgcaattttttaaaaatctcaactacctaaagtgtagaccagtattatctcctcaattatcttttaggtgctaaataaaatcagcacagaatacggcaagaaaggattgctacctcaaggaactaaaactctatttggggaggaaaatgcacatatatcagacatcccgtgagtgctgacagtttaaacaaagaccaatgggagcagagtcatctcagttattgccatttttgataagtcaaatgcacaacagcaaaatacaaaataaaatttaaaaatgaaatataaacatttatcttttcgtttgggtttccaagtaagtgttttataccaccttattgttcagccatcattgacaggggccaggaaggtatttaaactgcagggtatgtgtactatttgtcattcactatactcttcctccctgagtgcactggtaaaagtttggcctgaatcctccatgcatgacagagatgtacttttctgggatacaaagtgaaatgagtatgcctcgtattgtccagggcacgatttcttcatattacaaccttaagatattttaaattgtataactggaatcttttactctggaagaatagccagtgtacatataggttatcctttcttttaatccattaaagtccatacccatttcatgactctgcatggcatctgtaatcttggggtcagggagggagaaaccaaggtgtatgctaagactcttctgtcctcagcaaccctcttaacccaggtactgcttagattgaacaggccgtggtaactgataagcaacatctgctcatttcctcattgttcactctcatacatgactatgcataaactagtgtcattttctagaattccataggttccactaactctatttctgatgacaaacttgtttgtctttttttctttcgaaaccttatgtttcagatgaatttaaatgtagtccctgtttttcatttccagacacaaaaagagacaatggcttcctcttttcaaactgctttagaatattcttttgttcagaatctctttcaaaatgttgaggtttggttgtctttggtggtgtcccagaatgatggtttacatcatcccgctctcaacctctccccccatgcacaagctttgctttcctagaatataaccactctgctctggtgagcctcaaaagaaaaattctgattttaaaaatctaaagctttaattacttttactatttaaaagccattttccattataaaatttatcatataaatttgtctagttttgtctttaacctttttgctttgacctttgaacataccctgttatcaatgtttttgctattaaagctccttttgtttctttgcattttaatcactgttttgtttcatttgcaaactgactccgttcactgcttagtcctctgttttggttcttttattgtgtccccatgctgaatttcagacactgcaaaatgtgagccctgaaaagggcctttgcatttaccctattcaggagtgcaggatcattaaccaccacaaaataaaaactagttccaacttcctctgccatcagggatagaaagcagtggggaagctctgagagggaaggtagactagagccaaagggaaagcataggtcccggtagtgcttcacctggatatggatgtgtgtgtgtgtatggaatggtagtgtccttgcatgtggagttcccataagttccctagaagagttacagtaacagcagtcacgtgaaacttagcaaggagaccttgaagattttaaaaactcttaggcagccctgaagtgggtcctcagtttacacactgatagcccaggcaactcacccaaagccacatgggagtaaacactagagattcagcatggcaacccagatcccttcctctaatagtaggatactagcaaatactatttgcaaatactatttgctaatactatttgtgaatactatttgctaatactagcaaagcaacatttccaccttattctttggcttttactttttctcttgtgaatttagttctatgaaatcttgtttcagcacacatcttaattatggctggctctgacagttctgtctcaagtccacaacttcaacagactttatacccacacacaagatctatatatccacgccaaaggtcaggtgtgataataatgaagagggaattatcatttttaatgataagctacccacacttgttactatactttgcaagcacatattataattttcataggcaaagacatattatccttttattcattgtctcattcattgttttaataaatgttcaatgaacaccaattttgggttaggtgcctcgaagactatacttatattccaattccagtgccatggctctaaaaacaatgatctatatggttcctttagtatggtcttcagagaaaatttaaatatcagatttagtactttaaagacactatctgcctcttttggtcataaacattaattactacctataccatctgtgtcttttgccagacttggacatgaaggactttgaattagttctaaaaataaaaattaaaatatgtgctatagctgaggacatccaaaatgctgtacaaatgactcccaaacaggtttcaagaagagttccacagatattctgcttaattaatgtgatatataacaaagtaattaagagcagagacatagaaataggaaagacttggattggagtcccagtactacaccatttattagctgtctgacccctttaatctcactaggccagttttcttctctgtaaaataggaacaatcatggcgcttagatgggagggttatttgaagcttatctgcggtaatataagtaaagcatggaacccaggaaatgatcaacagaaagcgctataattgttatcactgctttgacaatcagaagagttggatgcattttattttaatatttacttttgaacaaaatatttggatgaagctgacaccctggcagttttagaaaacagttttgtgttagttctagttagtattttagatgtgatctgaaataaaagtagacaacagtcaattatgtggctctgtttatattttaataatttatttccatttatattttaatatttccagtaaaatttatgtttatagcttagctaatagaactatctaacacatagtaacttgcccattattctgaaatatgtggtcttatcatttctacttcaataaattttgcaaaacaaaaaggccaccaacacttacgattagcataacgaacatcttcaaaaggaaaatttacttttcaaataaatctgttttttaaattattcttaactgggctataactagctctccatttttatatttccttttgacagtgtgttaatttacaaaaggaaatacagaacattagctttgaccaattgataaatacatttattttaaaaggaagctgaatctttaaaatgttttgatcatctttgtcagttcataagatttatggctatttctccagaatttgaaaacctcttagcagcaaaaataaaatttatattaaagatttattattcaaaaaaccatctagttgggtagtcttttatatctctttccgttacctttccatacagtcttcttttgtctacaaaaatattttcagtcatttctgggtattgaaagaaaatatcttttagcttatattatttaatacttaataacattaatatgtcattaaatttttcctcatataaaaactagaaatttatttccagagattaaaaagttatgataaaattctaattattcgattattagaagcaattagaaagctacttaacacatatcagtccaggtattaacctgtaatttttactttgaattacaattcaaactactgtttttcaagacctccatttaatttgcataaacatattcatttgaaaagtgaattaatgttgcagttttcattctgttatatcatcctaatcccaattccaaaagcataaaaagcaatgtaaaattttatcactgttaacgtgctaggaaacatgcagccatgttataaaattattaaagtccagctgcaaaaaagctggggtttgtgtatttgttttcaaattttatctacttccattctcacctataaaaaggaaatgagttttgagtcacggcacagaatatgaaaagaaaatgtcaagtgacaatattaccagtttttacttcaaaaaccactctagttaaaagctacttaaatcctaatttttaaggcttcatttactttatgtggattttacttcagagaactcacacttttagtgctttagtccactgcttcttatatgaaattttttatttagttaatgaagttgagataatcagtaaaaggtttgatcagtgaggcaaaactccccaggataatcattcaataatgactttatgactggaatttctacttcaacatgtgctataactcaaaaatctcaagttattttagatagtaagatcgtaccagtttgacttttggggaaatcaatcctttgcttgtattcaaaccttggactctaaaatagtctcacctcacatactagaagcttctagagcaggactttctgagatgatttctttatcttattttatacatatccaatttactaacgtggcccaagtccacctgaaatttggcagaaataagacgtcagttgtcggattacactggtttttagatgcagttcattttcctttcctgctaccctcctcagaatcaaaattacctctaagcaaagaacctagatttaaaatacaaagaagaaaatccaacacagaattacctaaggagaagtgaaagaacttttctgtaaccaatgctatgccttcttggtcactttaatatttgccattttattgtacttttcccctcttccaaattgtagaagcactctatagaagtaaaacaaaaaagagaactataacgcaaactcttaataattcaaaataagtgaaaaacttagattcttgagccacactcccctatatgctacctaccctggcggacttacaatcaaatcatactttatttctttctaattaggttgaaagtagtatgaacaaggctactgcctatacacaaatggcactaattttcccatttgggtctaagtcttttaacttcaactgttatgcccctggcaaggaagtaaagctgaattggacaagaccaaaacatttcgtgggtttgatttgctgcggatcatgaagttggctttgcaaatggcagagaaggggactccttcactactgctaactcacaggaatcaatgtgaaagagctgtggggaattaagactcagaacttcttaactggctcagattcatatggactcaggcttatcaggcagaactatgatcaacccacgtagcaggttttattaattttccctatacaatctttcaccgctcagtagtcgatcctttgtcagaggcagcacaatcacagaaatggaaactgggccacaaactgcttagcataaatgtttccaaggccaataaaaatggcatttttcccctgccatttgcccaaaagtataatttttattaatataattattattttacttaaagaatcagtgctatttggacattgctcttaaatggaaattacttaataacacatttaatttagaaattggcttctaaattaatgctgacagcttggaagctggtatttagacaaaatagagtaagctgtgtattcgataaagccatgattaaggattttcaaatgagatttattttttctgttgtctgctgtattttagtacaaccaataactacatcctgacaaaaaaattcaattacataataaagcagaaacttctaggaagtccgaaagtaagttttgttctcagactctttttactcccctccatactgcaaaccagcacacatatatacaatcgatttttccccttcatctagactcttaccaaaattattttaataatttcctggactgccttctcacataagatgtggataaaaaagcctcaatatccataaatacagcaagcacttatattgtacaaataaaataactgacttactttctaaacacttaattgtatttaaaaagatgacatagttaagaagtcctcagtgaaactacagtttataacacaaagatcaaatttcgctgtttcttagttaagattgacctaccctagatccaacaaaagttgctgttttttttcctcacttccataaaaatttctgaatcacttgggagattatttctaaggaaatagttgtgaaaccaagaagctgttcaaacttaagcatcaattcttttgttaattcattttatgattaaaagaactaccaaaaacattactctctaagaatcctatcattatatgtattttaaagtgtcttcaaaaagccattttatcttaaagctggatttcattcctcaaatgttaataatctgggattgcatctcttgcttttttacagttaaaatttgtttagagcccccccgatgtttatatgccaaagctacctagatacacacaatgaagaaaaactgtggcaattatatgaaaaatataatgacatctgtcattaaatgtcaatgtttcaagtaaaacatttcttataaaaacctgttactgaagaaaagaactgttaaagtacatgaattaaagtatttttaattatcccaaatacgtaccaaccaaatttaactacagcttagttttttaggcaaaccaagatgactattttttttaatctgagaaaaacatggtatgtagaaaaattctattttattcagttcaacactcttcacttgaggatatgaaatttataagtatgcaatctccttgaaattgtaaaaatataatacacaattttatactaccttctaattttacttcctcaagcatttgttgtagtttctagaatagctatctagccattacactgtacataaaagtgatcctccaatttatttccacttctaaaaagatgcttaaatatagaataaagcatttcatacctcccttctcgtttaaaattccaaaaagggccaacaatccacattataggttaaacactttgtctctgttatacacttttcagaatttataagactgaaaaattataaaatttcatccaatgaataattctgtactttattaaagtctggtttctctaaacatttacctatcatctaagcaatattaacatgtacaacaaagtagtaatatggtataaatagaaaataaacactccaagctgataattccataaggtctaatgattctattaaaacaaacacaaatcaaaattttccattttagggccccaaattcaacttgaaacattttttatatgataagattaaagcagctgcccaattttcaggaagctctgtctcaagttaaggaaaaaaagagaaaggaggaactatagttctttgggtgacttaaatcactgccttttttactttttttgccttaaaatcaagataaagttctcacctaaagattaacctctgaagacaatgaaaaataaccaggattggactttaaaaaacaacttaaaagtcagccccctcatacaaaactcgacaacaaataaacctagacttaactgtcattttcaaatccaatttttacctgaattggtaaaaatttatttaaaacaaaatgcaaaatacaatattgtttcaattttggcccaggagataaacactttaatgcagagttaataaactccagcgaataaataggatcattttcctaatttcacttcaaagctgccaggatttcaataaggaagttcaaaggcccgattccagaaactagaggtccccggaaagtgaggggcgtctggccacagcctcagttccaaaccaggtatagttcttgagctgtcattcttagtcctattaccactaatacaaggtcaaaaaaacggtcctgtaaggtgtcaattaaggggtcacttttgcctaaggtttccttaacttctctcctagtgaagccgctctaagtgaacatttccgctgtgttttttttaatgactgccattgtctcgctggagaatcggaggctcttttagaagtactgttggaaaattcaggattttacaaaacattttctcagctgtacagggcaaaaacaaactttaatcctactagccatgggtgtaaaccacaagcctaatttctcttctaagaagggaaagcttagttaagttttaaagtgacagtaattttaggtggtaaaatgagctcaactcaaacatcgctgtatgaaagcgctctccgccaacacgctcatggacacacacaactccttcctcgaggtttagggacagagagcgaacctgtgacttcgggccaggatgacgacctgagatttggacaagaggaggcggcggttccgcgaagagccaagggcggccggcgctccgggatgcgccggaccccgcggcgcatcctcgtttgggcgccaacgggcgccggcggtcctcggacccgggtgtcgactgccgtgtgcccactgccgtgtgcccaggccccgaagcctcctcaactccttgaggggcgcctccctagccagctcagcgcgcagcgggaccaaggctctcccagcttacctgcgggtccgagtaggaggacagaagcgccgcccggcctcgcccaagcgcacacgaaggggccgcttcccgccccccgcaccccagaccaggcggctcacggaacaccgcctcccagctctggcccgggaccaggcggtcccccagccggcttcggcgccgcggccggggacgcgcgtcttccttctccaggcgccggacgtggaacct

SEQ ID NO: 1132 - DNA, 178015 bp, Homo sapiens
tcttttattttctgttcctctaagggaagagagaccaaagagaattctactttgaccctggcttaagagtggaacatagatgtctataaaactatgtggtatgtacatttataaaaattttaatttgcattttctctaggttttatgtttttggtgataacagaataaagtgtgcatgccatccaagataaatggatgaaggaagttcacttctttttaattatcttatactgacagataaagcaaaatagaaaaaaaattctgtatttaaccttaacaagctgagacacactagagaagtggaaaatagattgtgtgcatctgatcgtgctgcacattccctttaggttgcaatctctgctgttattaccgacaacaactgagactacagttttaactctgtatttacttctagttatcccacaattggtacatagtattggatggagccctgtatttcaaggagttcaactacctaattttcatagctgagataactaagtttctgagtccgttttcctttttccagtctgatctctccttttctcaaggctactttcgtttctgataacatactaaaggttataggatttatcggtattttgcctcctggggtcatttgttattaaaaaagaaactctattcaaataactgaatctctactattggattttccaaagctatgatagaccagctagtgaaactattttgtactggaatttggcagggtgatggggtggggagaaggtgtggagaggaattcttgtcctcagtcctgatatttctttccaggtgaatgtggtcttccgtgtgctacactccttgcctctctctgctcttctattcactatctaccagagaagatggagtgattcactctgattaataaatttggaaaaaatcaattagacatgctccgaatagttccaccctttttgtcttagaagacagctgccctcagagagcaagattttacctttgtaaattggtacacatgatctagcttagcattgcttttaacagggggaagtctgtataattcctggattattatcatgccagtgggttctcatattatactttatcctccaaattaattttttgtggtgaaattgatgcttttacttcttttcttttcttttctttttttttttttttttttgagacggagtctcactctgtagcccaggctggagtgcagtggtgccatcttggctcactgcaagctccgcctcccgggttagcgccattctcctgcctcagcctcccgagtagctgggactacaggcacccgccaccacgcccggctaatttttgtatttttagtagagacggggcttcactgtgttagccaggatgatcttgatctcctgaccttgtgatccacccgcctcggcctcccaaagtgctgggattacaggcgtgagccaccgcgcccagccgatgcttttatttctatcttctcatttgtgtaaagtgaataatgatatctcactgtgatttctagttcatttttgtgactcacaaatatagatactacttccgttatattacctgtttattttcttatgtgaattgctttctcatacccttttctaaattttctcttcagtactttacaaagggatttgaaagtgagtttggtgataatacgaaagtatttcaagtggacaaagtgcaaataatagtatcagttgatgttagcatacacacacaggaatgtcttcttttatagtaaaatttatttatttatttatttatttatttatttatttatttatttatgacagagtcttgctctgtcgcccatgctggagtgcagtggccctatctcggctcactacaagctcagcctcccaggttcacgccattctcctgcctcagcttcccgagtagctgggactacaggcgcccgccaccacacctggctaattttttgtattgttgttagtagagacggggtctcaccgtgttagccaggatggtctggatctcctgacctcgtgatccgcccgcctcggcctcccaaagtgctgggtatagtaaaatattgagtgtgtgtgtatatgatagagagaaaataatactaattttaagagagttatatgaaaattcttttagatttctaaggaaaagactgactcgaacaaatggacattttaagaaagctattgctacttagtaatgtatgagtcaaatggatagaaactccactatttgatgtgaggtgtctagaatgttgggaaagtgttaattcaatagtgctgtagacaaaaagttttccacattgatcctatttgttcacccatctccctccacctaggggaactactttttaaaagatgttatgttgttcaaatttcatatataaccaatgtaagtgagccattagtgtttttggagtatgaggtaatagattcctgtcccccaccaactcccttatttatcccctttatgatttcctcacatagctaataatgcaacaagaagagctttaggggtgcagagaactcagaaatatcccattgcaatagaaggatatgtttccttttaaggtagctccgaaacagcccattatataatcattttgtcccaaagcagtggctttcatactcaccctgcccatgggcctgaccataactgttatttcactaaatcaggttatttttggagtgcccaattctaagttggctgctactggtgacatacatttcattatagtttgagagttgtcaatataaatactccactcatagacaccaagaaggttcttaggaggcaagatctaatctttagaaaaattttattgacatttcataaaatatttatttaaagcttgagaaggaaactttctggctgttaatgtttttcagctaccaatgagtctaactcacgcatcttttttcttttggttgcaattattatacaacctcctgcacgcccgctccattgcacctgcctctcaaaacctaaagaaaaaagatttaagcagctaaaattttaataaaatatggaacagtcacatgaatttctgaactttaaaatggggaaaacaatcataggctctgatggctaatttcagaatcctttacatttcataatgaaaatttctatgtataaagattcaaactatttggagacttacatttcaaaggataattctactttttaggcactgtaacttatttttatccaagagaaagaagaaatggttaactgaaaagatttagtgacagtgttgtgataggagtcaaaacgtctctagttggcataagcataggaaaataactttgttgcaaaacacttgagctctgtttgcagaaatgaatggctagcggatatttttgttctctctgttatactaatggataaaggcatgctgataagtcactgtagctctgtggggttaatgccagaatgaaataccagagctgtactctttcttaggaaatagcagattcttacagacatgatcacaacacattttacagacaaactacattgcctcatgtactgtagcccctattctgtgctttgggggtcaccacaataatttctcttagaaatttcctaatttcaataaagcctaccatggaaacttatttggttgtttgttccctctcttatatctgctcctctgcgtctttcccttcttttctggcatttgtttttcttctgttcctttggagaaagcacagcctttagagctagtcagtttagaatttagctcaaattttatcttggtcacatataactatggaaaaagtatttcctttctaaaacctctctgttttttcatacggcaaatggagactatatactctacacttaggattagaattaactgagagacacacacattttctcattttcttttcttttttttttttcttttctttttttttttttgcttctcaatcagctcagttctctgtagtagatgaggtagttatcaacggggaggagctaggagtttccagcttagcaatttaatacttttaataactatacaattatttcgtacaaatacaagaacctaaacagcttatagagcaagaattacagtaagattggcccaccatgcttttcgcaatctcccatagttgtgctttcataaacaaaagtgctaacctgaacttccaaatcaacaactaagctctggctctattactacatcccagaaccatgacacagatacatgattatagaccctgaacaacaatgcccatcttcacaggcactttgaaatggggcaggtttcattttagagtatattttaaggcataagagtttgcctccagaattttaagttgtagtgaaaatactctgtctgtaacatagaaaaataagcttagaagactctccgagtttccttcatggattaaaaagttgaggattcttttaactacataaattctgtgtcctttcaaatagtagtacccttacaacttaaatagcacaggtgtacgttaccatttcataccgatcagccccagtggggcgtggaggtaggggaaacagttaaatagagactttcccagatgtgttccaaaatctgtcatttctgttaaattggtaattatcaaatttatgactaaataaagatcatatagagcttttctaaacacagatttcagagtctcaaatttagagagtctacttcagtagctctggagcataggctaagactctggatttttacaatgcattttaaggaatcttgatgtaagtagtccttgaactttactgaaaaactttgccctacaccctgccttataaataagttatacaactgcttcttggggctgttaagcaatggagtctagtgagattgttgcaatttcttgtgctgagagaaagaaatccaattaagaaatgtaaattcttcttcatgctgagagaatatgaggcaataaaaatatgaatttctttatgttgcatagaagcttctgggagcccataaagggtgagcaatccttaccaagcagctggactgtcatcatcttctctggcttttatgggagaagatgaggtacttttggcacttttctgaaaacaatctctttaagagtttctgtacaggctgcaaggctttttcttttaatgcttgaaattcataattaacaatttagaatgggggagaaatgttaaaatatggaataagtgcaatcctttttcaggatgattatctgatttctaattgcacccagcaatacagttgttcagaaagactggtggttgggaataaagaaagcgttttcagtaacttttaaggagacttgttagtgctttaaaaaagagtgaacaggctgggcgtggtggctcacctctgtaaccccagcactttgggaggctgaggtggacggatcacaaggtcaagtgatcaagaccatcctggccaacatggtgaaactccatctctactaaaaaaaaaaaaaaaaaaaaaaaaaaaaaattagccatgcgtggtggtgggtgcctatagtcccagctactctggaggctaaggcaagataatcgtttgaacccaggaggcggaggttgcagtgagctgagatcacaccactgcactccagcctggcgacagagcgagacaccatctcaaaaaaaaaaaaaaaaaaaaaaaaagagtgaacaattgaacaattctaattactactcatgctccaacatggctgtgttaccctgaagcagaccatagtacagggctggagcacatgggctactgttgaaaatgtcagaaaactaaaacaaagatgaaaagcaagtgggagtttggtgtgagagattctattgccttgatatgcccatagaagcagagttgagtgaagggagctgtttttgtcattgagaggttcctttcatttagttttctgagagaattctatgtgagcctggttgaatcctatctgccacttcaaatactgtcttcctttccatttttctgttacatatagtgaacttgttccaataaccttttcaagtagattcctggttatgtttccttccttatgccctggcttttgtaaattcaatctctgccttagtgattctaaatccacatcagacatatcctatataagcaaacatatgttgttcaagacatattcctaagcagcatcttctatcccacttctctctgtttttcattatgctcctgattcttgatttaaatgatgctattttgggaaaacaaatgtgctctgggattaacagcaattccctttgtaaaccaagcctgttaaaaatgcatttctagaagtccagcataatttgaaccagcaaatctaagcatcttctttctatgtggagagaattttaggctactatattcaaaaattgctttattagccacagaagaaatagccaaaagtagagattcccagaacaattgtaaatgagtcattgaatttagaacaccattttgaaatgattttcaatcactgaatagacttagtaagtacaaagacaactcaattctggtgtgtatcttcaccatttaaagatattcacaggtttaaaatttaatgttttctttgcatttagagtgaatttattgttggcagaaaatgcatgagagtccggactggagaattaagtcttctgttccctacataatggatctagcagaaatgtttagctatttaggattcatgagtgctgttctgccagtctacattaggcatgattagagagggccaactgaagctgggatgtattgaactctgtaaagtatgtgaaaccaccttgtgtcagggcctgtttaaggaatgaaagctaagaatttggctaagtgcacaacaatgtaaggattgaatatctcagcaatttacctcaatcataatagctcatgtcttttatcccttaggttggggcccattgtctagcttactgacttcaacttcctcttctatataggctctaggcctcagacatagtgttgatttctataagcaaccataggcatgttctgactgctgtattgtctcctaaagaaggcatcttacactgtaaagttaggaaaatcccaccatacctgaggtccaaagtaggggtattactagcataaggtcatatcactagttagtggaagagcagagatttaaattcagattttagaaaaaagaagtaaggtaaagttttgacaaatattggaatatgtgacatgtaatagatcaacttggtttgtgaattcatattaggtattgcattctgtattagtttctgccacaaaggaaggaagggaacatttatggaacatacagattttgagtcaggcaagcctgggttcaaattctgtcccactacttaatagcacagtgatttgggggaaattacgaaacctctcaaggactcactgccatcattgataaaatgggaataatactaaacttcataacaatttgcaagaccatttataaagaggttggcagagtgcctaagtaatagtagacttagtgaggactcagctgtaaagcctacactctccctaccataccatagatccttcctattggcaacatcactgtatttgtaactatgtatttccctgtcactctaataatagtcacaagataatttccattatgagatatcaaaatttccaagaccgtgtgataagtttgactaatacaattagaaataaagaaggaaatgccattatatatttgtaaagtaagattttaaatgagatcattgaaatcctacttgtttatctttcagagacactcagtgattcttttttcttcccaagtaatggattatatggattattatatatttaattgctattttgagaaaggtattcctccaaatgggcattagggaaacaggacagattttaattaaaccatttagcacatactgaataacctcatcaggaggcatgataaaagtatgcttaattggctcagaaagatggtagtaatgtgagaacttcaaacacaaagttaactgcagagataattctacatctatctcctaatcaacagcaagggaaactactaaacatttaaataggcaaggcaagaaaatcagagaataggctatactttcatctaatttgtctctcaaaaaagtttcttcaggtgtgcacgtgtattctattttggtgacaagactacataaggaagggactgctttatttctaaggctgtctgacagcacgtttccctcaatactttgtacagtgtgtatggtagtgtttctcattctattattcctttcattcttctctctatcccacctaaaacttaacacttttctaaatatcagtgccagcataggcacttaagaacaggacggagaatagaattgtctatcccatgtttctatttgtctccaccaggcaatataacgggtcagaagaccaggcagactggtcagagaatggggcagcactggaccaattgcaggacagttaaacagctagctagctagattgtaaaacagctatctgaagtcaactaagttctgaggtctgaaaaccagaagaccacaaaagatcaagtaaatgaatgatagaattgaaagaggtaggtataaatcagctcagttccatttcgcctgaatatagagaatggccattgtatgccaggacttgtgatagattatgaaaatttagaatacaaaagtaaaataatttcacacttgtttttctaagcagtattactatcagaggaaacatgtacatgagcagattataacaaaacagaatggtaagtcacttgacagagctttgtatgaggtgttagggaggcacatagcatggccacctattccacattccttgatttcactgttcatgattattgttatgtttgggatactaagaatcctgatgacatcattcttttatcttacttgagcttttctagcaagaatgttttcaatgtgagtctttttatagcaaaacttctgacatcagaatatcatttctacttctgtttttcatatattttagctttgattttatagcttccctctttttatatttttcttctgccttctggaatttttaatgtcatcttctaattcacatatttattcttaagtgtatcatcttctttgatcagttattatgtttatcatttccaccagtttacttttcagatttcttgttcttatgttactaatatatttccttatcttctaaagtattacagttattttacattattgatccatccattccagtgttcagacagtttattgagtttgtctttctttaacagtccttgcaatctttatacatctagttatcttccctaggtgctcatttcaccatgatggtatacttactgtgtctggtaatatgtactatggaatgcccaaggccatgccttcctctctgtatgtccaagttaatttagaaaaagaaaacgggcttaatttcaggaaagagagctcaggactattatttctctttgcagtcctccaccaggcaactgctgtgattgggatttatcatcaataccttaggaagaagcagcattgagaaaaggttattcgtctagtttgtcatctacaaacttggagtttaaagaaaggggatggagaagagagtgattaagtggggagatataaggcactatggataatataacaatccaagttaaaagggaaatttagactgacaaaatatctttggtttgctctcttaaccaacatgataaacaatgtgataacaattcaggctcaatgacgctaccagttatggcttttgtacttagggctaatttttcgttctttggactttagtgtacccataaataaaacgggaatatgatagtacccaactcttagggttttgtgatgattaaatgatacactattatatataaattttagagttccaaaaatgagtgtgttttactctggaaacttaaaaggtgctttatttaattttaagaaatacatggctgttgtgtaggcttactaaatggtttaggtatttatttatcccatgagtttgtgggattgtgcatctggggtacaataatttttaagtgtttagttctttgaacaattgtgcagcatacatacagacctctctgcctccctctctcccgaatgcaatccactgtgggaagcatgatttgtagctaatagtgaacatcaacttggtgaaaaaataaatttttcttacaatgaatttctctctttaatagggatttaattttgttaaaagtaataacaactaaataaagaatgttttcttcatccagtaagatcactgactttctcaaataactggtgatgctctagtatgtccataatggcagatatccagatcccagtgtgacctgctttaaactttgagaaaacagatatgcgcattaaaggataatggttttatgaggaaatataaataatctcaactaaccagactccattgattttcatagttccattgtaataaatgaaaacaaatcttgtgctaattttaaagatcatagatgctaagaggggccagtttagagaataaagtgatacagtaaaatgaaaaaaaaaggagaaatttctttttcattttgtgtgaaagaccagtatttaaagattgcaggatcaatagcacatttctgcttgaatgagagacagtgagatcaggaaaacatgacgtataaacaaaagaaaatggacataattgttcttgtattatattaataaatatagtggtaaaatggaaactagaacggatatgtaaaatgactaaaggaactgcagtgataaagtaaattattaatagaaaataccgtatgttcaactcattagtagtatttagatctctgacccacttagaaagaaatagtttttctgtcttagtgttcataactgctgaacaggccaggattggcaactataactaggactagatttcctacagtaaatcatttaagttgcatgtagtacctattatcaaaaagcaaatgaagaattcatttaatagtgtatgctggttaggaaccttcattgaaacctgattttcctccacgaagtgtatatgccttcaccatctgtagttctcaaattcaagccatgctaatgctaacaaagtggctggcttggcagatcaatcagagagggagcctggagatttacctactttggaaaggtaatttaaaactaaatccacctttagaagtgagtgtcccatttgtgtttataggtttcactagaggggagccctacatattagaagcatttccttttgtttgccaatagcagtgaagactaaggctaaaacccaaaaggatatgacttacacaagaatgagcatatggctgtcaaagttttaatcactaggaaaggaaaatatagttgcagcttgtagataaacagctctgttttagcaaaagccagatgaggacagacttggttgtaagataattggtaaaaaatgtcagccctttaaaggagcatatcagttttgcatgctcaataaaacaacaacaacaactcacctaaggagaggtgagtctaacaggaaaaattcaagcagcagaaaaatttggtacaataatctcctatgaactaaattacctgaagtattttatcagtatctttcatagagttaagaggcaggagttcaggcactgcatttaaaaatggtttggcacagtcattgccaatgttactaaaacttctaaagggataaggaaacaatttcttgtgcaattttggaggatcatatgattcatactatattggaattttcatggtaaaattgtcaatcccttggtgatttttccaactttcaacataaaattgcaagtctgttttgaaataggagcaaagtgcaatctgtctttacaagagctaaaatgtttgcaaatttcataatgttatcttatttcctgactgtacgtgttcctttagaatctttgaccaaaatccattatttacttgtaaaaagttaaaggctcaatgataaaatatacagtactcctaaatgtgctggtcaaatagactcaagaaaacttgatatgcttttatttaacaacaacaacaacaacaacaacaacaaaacctacttaaacaaatgtggaccatttttcagcaaatattttttaaaagcctacttttgactaggcaggcgttgttctttgtgtgaagctgtaaacttgaactttgttatatatttactatcatgatgtttctcatgtcttagcttcatatcctgtcttccctccctccatcactccctcccttccttctttccttccctccctccttccctccttcccttcctccattcctcccttcctccgttcccccctctcctcccctcccctcccctccccttccctttccttcccttccatttctttcatgcgcttccatgtgaagagaccaccaaacaggctttgtgtgagcaacaggctgtttatttcacctgggtgcaggtgggctgagtctgaaaatagagtcagggaagggagatggggtggggccgttttataggatttggataggtaaaggaaaaaggggggttgttctctggttggaggagtggggggtcacaaggttctcagtaggggagcttttgagccaggatgagccaggagaaggaatttcacaagataatgtcatcagttaaggcaggaacaggccattttcacttcttttgtggtggaatgtcatcagttaaggcaggaactggccatctggatgtgtatgtgcaggtcacaggggatatgatggcttagcttgggctcagaggcctgacattcctgtcttcttatattaataagaaaaataaaatgaaatagtggtaaagtgttgggatggtgaaaattttgggggtggtatggagagttaatgggcgatgtttctcagggctgcttccagtgggattaggggtggcgtgggaacatagagtgggagagattaaactgaaggaagattttgtggtaaggggtggtattatggggttgttagaagaaacatttgtcatttagaattattggtgatggcctggatacagttttatatgaattgaaaaactaaatgggataagagaaggagaaaaacaggtattaaaggactaagaattgggaggacctaggacatttaagtaaagagtgcctaagaaggttcagtatagccttgccagcaaagattatttatttacttcaagagttaagagtggcgatttggggatagcaccaagagatatcagctgtgatggcttggagaaacagtgtaaactggcagtgtaaacaagagcagggcaggtatgagtagttgagaacggtgaatatgagtatgactagacagaagatagtagagatggcaagttttctggggcacagtccaagttggtctagtgtctggaatgagactggggcctaataaaaaggagcatctatacaggagctcaaatgggctgtaccttttagcattctgaggacaggcctgaattctgagaagggaaagtggtaaaagtattgtccagtcctttttaagttggtggctaagcttggtgaggtgtgtttttaaaagaccattattctgttctttcctgaagactgaggactgtaagggatataaaggtttcactgaatactaagagcctgaaaaaatgcttggctgatttgactaataaaggccagtctgctatcggactgtatagaggtgggaaggccaaaccgaggaattatgtctgacagaagggaagaaatgaccatggtggccttcttagacactgtgggaaagtcctctacctatccagtgaaagtgtctacctagaccaagaggtattttagtttcctaactcagggcatgttgagtaaagctaatttgccagtcctgggcgggggcaaatccctgagcttgatgtgtagggaagggaggggcctgaataatccctgagaagtagtagaatagcaaatttgccagtccttggtggggacaaatccctgagcttgatgtgtagggaagggagggggcctgaataatccctgaggagtggtagaatagcagatggaacactgagaagttatttccttgaggatatatttccacgatggaaaggaaatgagaggttctaagaggcgggctagtggcttgtactatagcatagcctgcctttgctggtgtgtggcgattaggcctggtggaactgccatcaataaaccaagtgtgatctgcgtgagaaacagggaagaaggaaatggggtgaacgtcaggtggatcagagagatgcagtcatgagggtcaggtgtggtatctggaataatgtgggaggccggattgaagtccgggccaggaacaattgtaattgtgggagactcaacaaagagtgagtacagctgaaggagccggggagcagacagtatatgcgtcaggtgtgaggaagaaaatagattttggaaattatgagagctgtagagagtgagttgagcatagtttgtgattttaagggcctctaaaagtactagggcagcaggagctgctgcacggagacaagatggccagcctaaaacagtaaggtcaagttgtttggacagaaaggctacagggtgcggtcccagctcttgtgtaagaattctgactgcactaaccgtgcctaggaaagaaaagagttgttgttttgtaagggattgaggtttgggagattagctggacacgatcagcagggagagcacgtgtgtttttatgagaattatgctgagataggtaacagatgaggatgaaacttgggctttactgaagtaaagggggctgtctgtgaagccttgcggcagtacagctcaggtaatttgctgagcctaatgggtgtcagggtcagtccaagtgaaagcgaagagaggctgggatgaagagtgcaaaggaatagtaaagaaagcatgtttgagatccagaacagaataatgggttgtagagggaggtattgaggataggagagtatatgggtttggcaccacagggtggataggcaaaacaatttggttgataaggcgcagatcctgaactaacctgtaggtcttgtctggttttaggacaggtaaaatggggaaattgtaaggggagtttataggctttaaaaggccatgctgtaacaggcgagtgataacaggctctaatccttttaaagtgtgctgtgggatgggatattggcattgagcagggtaagagtgattaggttttaatgggatggtaaggggtgcatgatgagtcactaaggagggagtagaggtgtcttatacttgtgggttaaggtggggagatacaaggggaggatgtgaaggaggctttgaactgggggaaaaggtggcaatgaggtgtggctgtagcccaggagtagtcagggaagcagataatttagttaaagtgtctcggcctaataagggaactgggcaggtggggataattaaaaaagagtgcaaaaagagtgtcttctaagttggcaccagagttggggagttttaagaggtttagaagcctggctgtcaatacccacaacagttatggaggcaagggaaacgggcccttgaaaagaaggtaatgtggagtgggtagcctccgtattgattaagaaggggacggacttaccctccactgtgagagttacccgaagctcggcatctgtgatggtcgtctaggggcttctgaggcgatcaggcagcatcagtcttcagctgctaagccgagaagatctgggaagtagtcagagagccttgggccagagttcaggggctctgggagtggctgccaggtaaattgaacagtctgattttcagtggggtcctgcacagttgggacacagcttaggaggaatcccaggctgcaggcattccttggcctggtggccagatttctggcacttgtagcaagctcctgggggaggcgggcctggaggaacacttggccactgtgattgaggcatttggaagttcttgtgtgctggagatgtggctggggtttgtctcacagcggaggcaaggaattgtacaccttgaaggtgaggttaattaagtcctattgtgggatttgagggccggaatttaatttttggagttttatttaatgtcgggagcagattgggtaataaaatatatattgagaataagacggttttttgaccttttagagtctagggctgtaaaacatctcagtgttgctgccaaacgagccatgaactgggctaggtttttatatttgatgaaaaagagcctaaacgctatctgatttgggataaagaaaaaggagcattaaccttgactaggcctttagctccatccacctttttaagaggatattgctggacaggtgggggagggctagtcatggaacgaaacagtaagccagaccgggtgtgaggagggcaggtgataaaaggattatagggtggaggagtggaggctgaggaagaattgggacctagctcagcctggcgaggaggggagaggttagatgggtctgtagaaaaggaagattagaaagactcagtgatgcttggggttgggactgaggggacaggtgggagggaaagaaggaagatttgggatgaggtgcattgggaacagagactagggagagacagatgtgtaaaagaacacctggatgtcaggcacctcagaccatttgcccatttcacgacaagaattatttagatctggtaggatggaaaaattgaaagtgccgttttctggctatttggaactactgtcgagtttgtattggggtcaagtggcattgcagaagaaaataagatgcttagagtttaggtcaggtgagagctgaagaggttttaagttcttaagaacacaggctaagggagaagagggaggaatggaaggtggaaggttgcccatagtgaaggaggcaagcccagagaaaaaagagtagagacacggagaaggggtggggagttcttgccctccaaaaaagcagagaaggggtcagggcatggagataagaggtcacggtatggaaataagggatcagggtgcagagataagaggtcggggttcctgcctctcccccagaaaagcgggacttgccgctaagggtgaaggaccaaggcaggtgtccctgtgtggtctgacacctctgaaacctgggtgaataatcagagaggtgtccctgcagtgattaaacaccaagggaaggctgccttccctagtccgtgaccggcgccggagttttgggtccattgataaaacatgtctcctttgcctctaccagaaaatgaaaggaattgaaattaagagaagggagagactgaagtgtggtgccaagattgaaaggagaaaaaggttgagggatagtgagggaggttggagaaaagagtaaaaagaggctacttaccagatttgaaattggtgagatgttacttgggctggtcggtctgaggacctgaggacataggtggatctttctcatggagcaaagagcaggaggacaagggattgatctcccaagggaggtccccccatctgagtcacagcaccaaatttcatgcgcgtccatgtcaagagaccaccaaacaggctttgtgtgagcaacaaggctgtttatttcacctgggtgcaggtgaaaagggagtctgaaaagggagtcagcaaagggagataggagtggggccgttttataggatttgggtaggtaaaggaaaaaggggggttgttctctggttggaggagtaggggtcgcaaggtgctcattaggggagcttttgagccaggaagagccaggagaaagaatttcacaagatagtgtcattagttaaggcaggaacaggccattttcacttcttttgtggtggaatgtcatcagttaaggcaggaaccggccatctggatgtgtatgtgcaggtcacagggtttatgatggcttagcttgggcttagaggcctgacagtttccacatatatttgaagtttctttcatatgccatgcactagctgaatgaaacatagacttggccatttcaaagttcacagtgggaattgatatgtaaacaccaaagtatgatagcaaaagtatgaaaattagattcacaagctaaaatgttaactacagactaaaaagcaaaaggctcaaacaaacaaacaaatataccacatatttaggttgaaagatgctaaagtgattaagccaatcttacccacatggaatattcatgcattagaccggagaaggtgcagatacagatgctacactggagattatgtataaaaaaattctcagaggtgttgcattgatttcctattattgccataacaaattaccgtaaattcattatcttaaaacagcatgcatttattatttcatcgtctgtagttcagaaatttggcatgggtctcccagagctaaaatcaaggcactgtcagggctatgttctcttctggacatactgatttcctttcttttggatgtatacccagtaacgctgaatgctggatcatatggtagttctgctttttaaatttttgttgaacctttatattgtttgccttatggctgtatgaatttatattcccacttacagtgtgcaaagtagcccttttcttcacatcctcccaacacttgttttcttttgtcttattgttaatagccattttaataggtgtgaggtgatagctaattgtggttttatttatttttatttttaatttttatttatttatttatttttgagatggagtcttgctctgtcacccaggctggagtgcagttgtacaatcttggcttatttcaacttcggcctcccaggttcaagcaattctcctacctcagcttcctgagtagctgggattacaggtgcatgccaccgcacccagctaatttttgtatttttagtagagatggggttccaccatcttggccaggctggtctcaaaagtcctgacctcgtgatctgcctgcctcagcctcccaaagtgctgggattacagacatgagccaccatgcccggcttcattgtggttttaatttgccattcccagatacttagtgatgttgaacaattattcatatacatgttggccatttatatgtctctttttgacaaatgcctattcatccatttttaaattgtcttgttttcttgctattgagttgtttaaatttcttatatattttatatgttaatacattatcagattgatagtttggaaatgttttctcatgctctgtggattgtctcttcactgttgattttttttcttggctgtgcaaaagcatttgttcattgtaatcccatttatctatttttcctgttgttgtttgtgcttttggagttatatgtaagaattattgcccagatcaatgtcatggaggttttgtcctatgttttcttctaataattttatagttttgggtcttacatttaagtcttaaacccattttgacttcattttttgtatatgttgtgagacaaaggtccaatttcattcttctgcatgtggatatctggttttcccaacaccatttgtagaacagactattctgttcccattgtgtatcttggaattgttgtcaaaaatcagttgactgtatatgtgtgggtttatttctgggctttgcattctgttccagtggtctatgtgtctgtttttatgccagtaccctgtttttaggctactatagctttgtagcgtattttgaagtcaggcaatgtgatgctcccaggtatatttattttgttcaagattgctttgactattaggggtcttttttgtgttccatacaaattttagaattgttttttcttattctgtggagaatgtcatttgtaatttgatagggattgcactgtgtctgtaaattgctttgagtaatatggatattttaacaatattaattattccaatccatgaacatagaatatttttcatttatttgtgtcttcttcaattctttcatcagcgttttatagtagtcagaatataggtctccccactctttggttaaatttattcctttttttgtagctattgtatatggtattattttcttgattcctttttctgatagttctgtggtagtatatagaaatactatgcattttgtatgttaattttgtattctgaagctttactaaagttgtttattagttctaatggtattttagtgaagtatttagggttttctatgcacactctatatgattctatatatattttctgtcattcacaaacagggacaatttaagtttgccccttccaagtttgatgccttttatttctttctctaattgcccaattcctctggctactaataacactctgcctgggattttctagtactctccttcagtattcatcaggtctcagtccaagtgttacctcattagaaaaagattctccatctaattcaattagaaaaaaaaattcatctaattgaattaccatataattcaaaataacctcccaattcaatctctatcccttcattctttaaaattttccttacatctcttatcattcttttgctcacttttctgttctcttgtatacgctcttcttgtatcccatcttcctctacattgtaaacttgatgaggacaataccttcactgcatgccttgttcgttattgtgccccgaataccgagtccatggttggcacacaataaatatttgtttaactaaagcatagcttgtatttaggggaagttaagccagttattggatagatgccatgccactggcaatatttcaatgtaatatctgaaggtaagattgcatctgcaatatcatattattctctaaaaatctgaacaaagagatcctttgatgatgattttattcataaatgtttgttttcttctccaccagtactgggacagaaatttgcatataattggcactccattaaaattgcttgcattatttcagcctagggtaaatacatggtagctgtaataaaacctctcaaccacaacataatccgaatagaaccaaccttcagagatagaggaagatgatcccaattgtctagtgattgcaaaattatattaaccttaggtaaagtccattgtgtataaattatggtagaagcttagtgcaggagaatgaacaatagttttagtgtcagaaaatgtgagttaaattcccagcttaccttattactggacctatgacttgaggaagttttgtgggttttttctcttttgtttatgtctctgaactttggtttcctgaataggatagagccgaatatttaggtgacattagtgaaaagggaaaatgtgagggggatgcataatcacatttgggaaactgtggatattcttagaacagaaaaaaatagattagtgaggttttgaatctttccacttatcttggtaaggattatatgccaaagactagttattgtggccatactctttttccattagtggcattggagaaccagaaacatgggatccaaagagaagcttagcaatgttaagtcatgttaatactaatttaatttttgtttgccaccctacccccaccaaaaaaaaaaaaaaaaggttataatgtgattgtcacgacagcatggggctgtactgagctttttgtcatgatattaaataggcttctctgttagaaaaagatttctggtctaaggacccaagtagatcatataaacagaagtgtgctgttatggtggaggcatattcatgttggttctgcattcacagtgaacatttgtacccaactcctaagacctactagagatcaaatgtgtttaaattgagtgtactcagatagaaagatattctgaaatttctcagctcttttctctatattgttgaaaattatcttttacaatgcaaagcctctttaacttgtaaaatatattattatactttgctttgagtaatgtgcaagttaatgtccctcccattccaatcataacagtccctcagccaactgtaaaagatgctttaatgattattttctttacttaatgtcttttttcatctagggttagacaagtagagctggagtgccttgcctatgcgctatcgttcgttttaaagattcttggggagttaaaaataaaagaaatttagaaaaaagaaagttgaaagttaaatgactgtattaacatagtactaaccagtaaattaagagtgcaatgaaataaaacaaaatttcaaattcaaaatggcttatgtcatgaaacccttaaggtattttaaattttcactgtatacaaaattgtacaattagcaaggaacaatgtgctaatgggttttaaatattcattttaggcttatagttttcagtttatacattttttggagagcttcaatacataaataccacaacaattcatttaaaatggtattttttagtttcctaaatgatttggatgcccaagtctctttctataaaagaatttcttagtataataattaggcaatagttcaattcattccaaatgcctagtaaaatttctcctaactattaattatatcttaataaaagcttccaagcgaaccaaaatttttttgtttcaaagggttataattttactgatcgtataaaaagaagctaagttaaagacagcaaacctactgggtaaatggaattctgatctcattctctttttgcctaagtgtgccagagaaagagtgaaaatgatgagattggtgttaaggaaaatgtttttatttgtgggcacatgatggatttctcttgatcttttccattttgctgtcttttcctcctggattctgacagtactaaatattctggtaccattctatccacctccagctcattaatcaaactctaagtttcataagtttagaggttgtttattattctttcagtatctccaacagtatatgtaacatatctattatttagctacttgacacttaaataaatatgtatatgtgcacatgtgtatacatgtatttacatatgtgcacatgtgtgtatgtgtattgtataataatagaaaattttctggtctttgtcccagattcctgggatagaacttctaaaccccagacatttcttaagggagaggagtatttgtgttgttcatgatagtctctgggtttatgcttataaggtcacttatggtggacttttagatagcttatgttaacaagatagctcagcatgaaggcagactatgccagaaaaaccaaccatgtaattagaaggttggtgctttgaaccagatgatatcagttcaacctctgggcaagagagatggattggagattgagttaaatcctgtgcaatcgcactgcatagcaagactccagtaaaaactctggacactggggctcagatgagcttcttggttggggacacatcaatgtgctgggagggtgacatggtcctgattccatggagagagggccttcaagaccctcctagacctcttcctctggcatctaaaatgagagcagtcttgttggggactatgcccttgatctgtgggatctgcactaactctgggaagttactgacatagttgacttgcagtattagataatctgtgttaaatatgtgtgttaaaatatatgaatatttctatcttagagtcgctaattaatagtggcagcaaagattctcaatccttatggtttggaaaagagatttacacctttaccatgaagtgcttttattgtcttgcccaatctcagaacaaaaccaatacacagttagcactattaatcccctcggaaaactattcttctggggtttgaggaaggcttttaagaggttttactaccctatgtctgataaaatactagataaagactgcatgcacaggtttaaaacttgaacagattttttgggaaaataagaagggcttaaccatgatttctattttgtccttcctatgtcctcttccattttatggcttaggtttattaatttcccctaccttttctccatataatttccttttccaaagaatggacattacatgctcattttcactaacatgtaaacaatgaatggtgctttagttgttctcctccctctgagcagagttctttttcattcccttatcaatatgtcaagaagccccactttctattttgactctacaaaattgtttctcataacatagttggatgaaacaggcctgcctcctgtgaactctgtctcctttgttctctttataaaagtaggaaaacagtttattatgtcagacactcttttaaatgctttgtatgtattaggtctttttaatcttcaacaaaccaggaggtaggtgctatgttaatcttcactttatagatgattttgtgagacacaatgagttaaaagcatttactcgagaaaatttagctagtaggtgacagaaccaagattgcaatcaaggttatttgattctgaagtccatactcataaattattgagctatgctgcctcacataaaatgcttctcggtgctggagaactgtgttcttgttctatcctaggaagagaagtttgtgaaacatttgaaaaaatttctcctatttccacagtcttatttctcaggactttcccatatgttccctctttctactatattgaattcttggttatttcctaaatgccagctactttttgcaacttcccacttgcttttttctctgcttgaagggcccttctctatttctctttgtcacttacttctactcattcttcaagtcagcttcaagctttccataaagcccagtatggggaagtaaccatttctctgtctctcatcagtatccacatacttttatttgggcacttaccataatctgtggtgacccttccttacttctgtttacctcagaagactgaaaccaacctgatagaggtcttttatcttacatttctctatctctagtcctagcacaaatttgagaacctaataactattcattaaaagtttgtaaaccagagaacaaattaataaaaccagataataacattgcaatatttctgaaaccaaggtttgtaaccaaagatttttaatttttttatatcctaagaggttctaggtattgcaaaaacaaaacaatactattgtgaacttacttaattgcatctgaaattttatcttaatcccagacattggcttaaggttacagtgaaagaaaaagtaggtaaataatttcatcgccttacccaccctttcgtgtttttaacacttcaaacatacacccaaacacacaaaaacacatacatattgccatgtgtatactatggatatatatacttcgtgtgtgtgtgtgtgtgtgtgtgtgtgtgtgtgcttgtgtatgtatatatttcctcattcccctgcgtggaaagtgacaaagtatactatcatttaaaattactttcttaacatcatgataaaatcaaaataaactgtcacttttaaagctttgtaattttataccccatcatcttaacagctatgattcacagagttttgagagtttttaaataatgacttaatctttgattttgaaattcagaaaaaaaatcaaaaggaatggatgtattcatgattgcaaaagaacaattttatttatgaaaatactaacatttatctctgtctgtatatcttgagatctctcaggatgtatgactctgttttgcagaataaaagcctttgctgtatgatatgagtgaactattctaataatgaaagaaaatccatgctaaccttaaatctgtataactgcatagcactgaccaggaaaagccaacttgaaaggtactgcttatagaagcatgtcagcccctattttatggtggatcctgtcacttttctcaggagagatgtctggatcagtgtgctaagtactctcctgtttctaaaaattcccaaagaatgtctaaaatcagtagttcacagtttatgtagatcataatacaactgacatctgtaagctgtagaaatagatacacactgacatggctaaaaagtacctgctgtttctgtgaagagaggccgaagttttctctaggaaacgtactacatagatagtgattagtattcctctagatacctctggcttatcacagttgatattctcttattatgccttcttcattggggtacaattcagattttatgtaaatgcataccaacagggatattactttacttcaaatttgagtttggttatagaccaatggttatataatgttactacttcactaattttataagttgctaataactttctatgtttatgtagtatttacataatggatggaggttatctgccaatagaaaacaacaaatgccatcaggacttagttgatagtgaatcctgtggtaagagctttacatgtgattgttcgtaagttcttatttcaattaacaggatgagtttaatgagattacaaaacttgtcaacttacctgggaccacacagctagtaagtggcaaagccaaggttcaaatccaggacttgctaattccagtgcccatagtcatcattgttatgtaaaactaccttctttactgcagatatggaaaggctttatactacaaaacagtaaataacagggaattaatgatggctgcactgtagagaaactttttttttaatgttttgaattgcactcgatcagatagttggtttttatttgccaaagaccagtatgatttacaaattcctccctattatttcaaagaaaacacagtgtgatttccaaaggtaaggatacaatcatttctgggaaatactagctggcatttgcagagaataattttgaagaatacacactttcttgaacactggtgtggcctaggtctgggtagtagaaaactaggaataacagtagctaatatttcagatctgcgatcaatgaagtgaaaatctaaacatgggcaaaatgatgacagagaccaaaaattatgtataaaaactgtgataataaggaagtggtgaccagaatacaaattggaaccatacggatcattgaagcacgttcatgaatagtgcaaaactatgatgatgaaaaatgatttaaatggagcaatgacagatgattttgttatcctatattggcaagggattaaaattaacacctgaatttaactgtattaaatattttcagcttctgattatatatatgtgtgtctacacatatgggttatatgtatgtgtctacacatacttggctacaaaactgaaatttgtccttcaagttagacccttacccttagtgtgccccaaatctacctgcagcctcctgtggaaaaatggccagagttttctctaggatgttatatagctagtgatgaatttttgcttcaaagaccttagcttactgcatattgtctggtaagctgcttatcattcctttcaaaatatagtttcaaacactgtcaatgaagtatttctaatgtgaccgtaaagtatgaaagaaaagatccttttcagttattgttaatctatactgggagggtccgggtgacaaatgcagaacaataacatgctcagatgaaacagaccaggaaaatgaaccccttactaacagggaacacatcaaggcccattcctgtcttggaattaggctagttagtttacactgcatcatgtatttggctccatataacaattgctgttggcgcccaccagaatctctaactcatttttatttcatctaaccgtaaaactattgattaatacatttgttattaatcaatgaaaaaatggtttatcttctgtgtaccttctagtcctcccctgcatttctctccctcaactctcaacaactcatctgcttttaggatattttatgagactctagttcagttttcacacagtactcttcagtttggctcatccattcctttttgtggagactccttcctatcttccccttttcttcattgttggtaatttatttctaggtcctgtcctcatctatcctagtagcaaatttcaacagaaacttagttctttttatgtttgatcatgttaaatttttgtttataaatcaagggtattttaataataggtcaaatatctaactataaacatctaaatatacaaaataagaattagaaaatgttcatgtttgtttaataatattactactagtagtattaaattgtgattcctagagcatccttagcagcacaaaagtgatttaaaaggaaaaaataattttaatgtcatttccttgtagcacttctgccttatttttaaaagactttaaagaataactgccaatgaatttaataatatcaaagcctatcttgttcaaccacatatggaaaaaaaatactaaaaatgaaatttgactgaggagtcaagcaattttatgatgttcttcttctattaggtaccagcatgttatgaagaataagcaagaagaaagagaaggagaagaagcaggaggaggaggagagaaggaaagggaggaggaggaggagaaaaagatggtggtagaggaggaggagaagaagaagaaggaggagaaggagaaggagaagaaggagcaggaggaggaggaagaagaagaagaggagaagggaactcacatgtaagttacaggtatttttgtattcatgttatacattaaagaagctgaaattaaacaaacaccaaacctgtattcaccatataatatccttactttccttttagtctctgctgtaatttctctgcacttttcaatcatttaattcgctatcagaatcatgaactcaccattttgcctaagtcaattttgttaaagttgtattcatctagtcagatttcctgtaggttaatgttgagtgtatatctatcctttactgtcttagtataagtcattatttgcacagctacctatgattttgccatttgggttatgacgaaaaggttagttccaagttctatgaggaataaagttctaatggcctacttctattattacattaagaggtatggaaactgactatgcagttttcataaactcatttaatgagaatgaaaatattcatcattaaggtcattgaaagaaaacagtataaagtaaaagcttctgaatagacagaagccacaaaattcccaaattatactctttagaaatttttaactatacattattttagtgtctctgaaaattttaaaatacccctttttcatgttttatattcatccctgtaacattttcaaacaataacatattttataaaacaaatagccactgtgaaacaaaaatactttctagtttttattttctatatttagatggaaaaagagtaaactttttgctatgattataatttcttcatttgcagttattgatgaataataattatcactttagttttatacttaattggcatatcacattgggtaaccgactttctaagtcaaccatccaaaagccaacttaatgttagctacaaaactatctgattgaagttcatggagttttaaaaaccattaacttttatgtgcagagtgaaaactttgctccactggcacataatttcatttttatagtcaggagataacaataacatgaaaacattactgccaatggaaatatgcctcatgaaaagtaaaaagtaaaagaatatgaaagattagttattttgagataggtggctttgtatatgttatagaaagcaagaacaaaaatgaatctaccctaggtgattggatgaccatggcacttgaggataatacatagaatataatttttactaaaaaagtacaatggtcaaagcattcaaagtttttctcaataatgcacttgaaaattctctgttctgtcatccattgatatgaaatggtgaaaagaggactttaaaaaagaatagctaatttcctgaataatagatggaacttaacgttatgtgaaccaacgttgacagtagtgtctaaattaatagttagcaaagtgtttcctgttcttcactgatctttgcaattatctgcaccagatcatttactcttattacagctttttacagcttctttccatgccattggggacattttcctcctcaagttgtctccagaaaattaactttgtacagcaaagccctttagaattattattatttttttccagatttttatgcatgaaaataatatactgctgaaaactattattggttctcaacattttcttatattgtgtttttaaaagtcccactattagataattttttaattctttggtactgttacacagggtaggaagaatccttctgaggtatttattagcagtgatataaatacctgatccaaatttatcagtgctaagggttttacagatattttaaataatgaattgtgtatagtgctttccttttcactaatcccttcaggtatattatctcatttgatctcctgagcagctatgaatatcaattttgttatttacaggtgagaaagtggaggtttgaagagattaagtgacttgctcaagttcacacaatttataagtagttcaattataaagcatttatcaggcatatgctatataacaggtagttttctaactcattaggatattgcaaacaattttttaagtacctacacttgcaggattaatcacaaatgtgcaaacaggcaggtagagtctcaaatatgtacaatgtaaaatatattcaaacaacaaaagtatagagatgtaactaattgtacttcttgcaagggtcagggactactttatagagtggttggtgcctgaattacattttgtttggtaaatatgagtttgtcagataaatgaagggagaaatgtaccaaagtagattttgtaacctacaatctaacatactctttactatataacatcacctctataccatgctatattgattttctattgatagtataaaattattactataaaatttagtggcttaaacaacacacatttttatcttacatttctttagttcagaaatttgaaatgtgtctcattgggctaaaatcaacatgtcatctaggctgtcttcctttttggaggcactaggaaaaactcaatgtccttattcttttccaccttccaaagaggattcacattccttggttcgtggctcccttctcccattttcaaagccagcaacagtggattgagatttaatgtcccatcccaccgaccctgctttagttgccgtcacatctctttctctgaatacaggcaagaaatgttctcaacttttaagaagtcatgtcattatactgggccaacctggattgtttaggaaaatatccccatttcaaggtccttaaccttaattacagctgcaaagtcccttttgtcttgtaatatattcacagattccagggattagaaaatggacatatttggggggtgggaattattctgccgaatacacgtgccatttgtaatcttaaattatttcttgtctcgcatggatttaagcagactttcttacctgtaagaactagattattatactgatgatgttacgtattttgcctatgacacgtcaaaaaagaggggtgaggaaagctcacatttttacaccattttctatgatcttagagatgtcattttttaaatatgcagttttagaaaaattcaaaaagatgaagaagaggtttgatcattctgtatgagctcattgactcaggtactaaatatctttcttgtttgccatgctactatttcccaataactaaaaaacctttatctttagcttagaaatttctcctcatcaatccaaatacctattgatctacaggactctcaaacacaaaacacttcatgctggcctattatctatactctttttctacttctactctttctgttctgctcccaacatcagagaagggcaaaagtatcccatcaattgcaagaaccataatcctggaagtcatcttatctacagtttcaaacaaaaaccaaccaaatgctagaaattttaccaactaaacatttattaaatcagtccatatttctctatacctattggcatatccttaattcataatctcctattttggttatataacaaatcactaattagaccctttgtctcaagcttctctcctacttctctctatttaagcatccaggctacagccagaggattcattctaaaataaaaactcactttattaactgtcctacttcaaaaccctgtaatggctgactattctctctagataaatacccaacttccaaaataccctggataattttaatttcccttagtgccctgtactctttctcgctgtctgctctttgttcatattatctcttattactcccttatcctcttctttcttctgctccaaacatatttcttgctctttattatgaaatttaaattatcacctcctctagggaactcttcctcttccccacagctaggctctgctttacttccttggggaagaaaatgcattggattaaaaatgagaaagaaaggaacatttattgagacattatatgctaagattttgtcctatatgctttaaatataatatacgctaagtcatttgaaaagttttgtgaagtggttattagagaatttacaaatagaaaagctatatggtatgtgaaaatgcagaatggagtaatctgggaaaagctagctggctatggagacacataagttgaccttgattcttatgtcttcatagtcagggcttgcctttcattcatgcagtcttataaagtttcatcaggtttcccaattggatcagattcagagatgctatctcacactaataaagttcttatgaaaatcatatagaaataatttaatttactgagatatttttctcagtactcaaactactatgggaagtcacatcagcaaagctttgtttggtacacactagaaaagaaatagttgttaagacttaaatgctcaatgcttcaagcaaccctgtccatttttacacttgcttatttgtccagagaatcaaatgtttaggtcagcctgacaaagtgcctcttaccctgggcaatgcatgaatggtcattgctgaaaattgcctaggtctcttatttttccgtgtctttggactgaccaacctaaaaccaaggaagtgttctcattctttagatgttattgataattatcacagggtctctctgagtacagaaataacttcactattgttcagttctgatgcatttttttcagattgtaatttgaagaaggcaggtttgtttgctttattaatatcttccatggagctctgcattattccatcttatcctgtaactctttaagtttcaactctaggtgttaataattctgttttacagttggataatttatgcttgagtttagtaacttttcttaagtaagaggtggcattcaaagagagttcctctgactccagagcccttgctctttcaagctttgctcgccagtcttagctctgtttctaagtaaatgtttgccattggcagatcactaactgccctctgtcccaccttgcttatcagaagggtgagatgttgctctaaattatttataaaatctcttccagcttgatttattaataaaaggcagtattatttccctgctttcctaagtctaccaagtaatctctttcacaatgcaaagcagaaatatgctatgaactaaattcccattccagctgcccagatactggcataaggttgactaaagtcgtatttttcagtattgtgagctttcatcttttttttcttctttatggttaatttaatgagaggttggttggtcccatttcttatacaggaaagagattagggtttggatagctccttgagctgctttttaattatctcagatttcacatttttaaagaagaaatggctgtaacttattcaagaggaataaaattctgtgatgtacattataactatagtagatcaaaggcctcattttttgcactgtgcaggtgtagaatttctgtgacagaggaggatccacgataggcagtaaaaaagggaaaacaaaattacattggtttcacacatttgctttgcaacatctgtttaggtggaaagcattttgcctgtcgatttattgaggagtttgttcatgacaagccatgtctgtctatttccctcgttattttgaaagctttgagtccaaagggattgaagtagcctggctaaattgcactgatgccagtaaatagtgactttgtatcaggggcagagtgagcatctgcttttcttagaatgctggagcaagtgtgatatctggggacagagaggtagaattggactgacagcttagtttttctgctgccctgaatttactaaagttagctgtgaaaatagcccaacttaatcaatgtaggccagtttgtcatatcattgtttcctgtgacattggctgttcatcaacacctgagacctcagtcagtcagtgcttcctccccacagttcacgcacacatagctgatggactaccaccttcacacagagatctcttaaataaaaatttaacctaactttaaagtcctatattgacaaaaagaccatatagctgttctgctaacaattctggatatcttcagcatccagcgagtaacttttttcccttagggagaatgaaagggaagtaggaaggatttttgttactggttaacaaaaagtcaaagtactattttacagcagtaaccaccataaacagaaacaaacaaacaaacaaacaaaaacccagaatttaacaatcccttgcactcctagcatccaacccatcattttacaaatcactttgagaccaggagtgggtgaaccaattgtaaaggaaccccagccatcatatattatacttggtataatataccatgtatattacaaatgattcatagtagctaaaatccgttttttagaaaagcatagctgtgtacatcttgagatgcaagaccaacactgaaaaattctgagtgatatttctttcccccccaccatggtttaagacaaaggaactgggagtagaaagaagtagtgccaattttaattattgtcataaagtcaatagcaaacttcagcaaaattatcatctcaaagatgtgttttggacgtgttcttctctgtatcctatcttcaaacatatttggaagcactatttatccttactaggtcttcagaggggagcctggaaactacctgattctttgtagaaatagaatctgaccttattgcttcccaatcaaagagtgaccattatcttgaacccagttggaaagctgattactttattttcttaaatcagtgggtacactgtactcagatgcctttattttattgcttgtctagttttccagatgtcttactaatgcataggcaaatgtgttcaatagattcagtgaagtttacatgctttccagagagatacttaactgagtcagttactgggcataatgtgtcataccctgggtctttgaaatgtgttatcacagatactctaagtcaggaattagttgtttagctcaattgcttccaaatatacaacattctatttgtgtaacataaatagcaagcacagcgggcaaaacagagagactaattgagaagcccttatgtttaggacaaattctatcaatgcaggtgtatggtatattaaagagagatgaaagttttgcttagcctagtcacttgtatcaaacatatttttttttctatcacaatgctggatctctttagagaattatttatttgctcacaaaatcttgtcaaaattgggtatcagtgaaatgaatataattattaactctgaaagttaacccatttctgcctgaggttgcaattctttgaatttttgcaatcagaccttggcgatggccttgagcagtaggatataaataattcccacatgcttaatgttccaataatggaacactaggcataaatggctactcctgctgggtttattccaaaagttgcatcaataaaaagcatttcggggaggggtcaccagtaaataagttgaaaaaaatagtagaaacataatcctagatatagagaaagaaagaaaatatgagtggggaagggtttttggaaatgtctatacttctctacagtcaaaaaacattcatcccctactttaaataaaacttcctgcttcccataatttgcatattctactattcagctttgccactgagaagctaatattttgtaaagagtttctttattaattttgggcttttgatataataatctcatatttgctgaatacgtttactcttaaatgacagttttgtcattgttgttgacctgaagcagggtgtatttttaatgggagatgtgaagaaaaatggaatagaggcaaaaaagttattacccagttaccatttttagaaagtcattttaagtagttggaaagcaattctatttgttccttcattcactgatgagaagatctccatagtgaggaagttgtgagagggagggattaaaattaggcaactattttacaaaacaatacttgcgtgtcactttgctcagtaatgtctttttagccatgtggatttttagttcatcaagtctaattctcttgtatcctttattgcaggctacctgtgtgagtcacatgtcagtgcaatttctggaggtcaattgtagccctgaagtctcagaacaatggcaaaaagaaatacggagggcatgatacatttggtaagtgccttatgtaaaccacagaaaatgatagaggcaatttttttctttcctaaggctggtgatttattgcatacttcttgtcacggaatagataacataggaggacaggaagaaatttgctagtttacacagtgccccctgaaaataattcatcgaattgggctcctttggaaacattcacatattctgcatgtatttttaccagacacatttagcatcgtaatggcataataaaagctatcatttgggaaatatacacattgctcctatctgagtgcacagtggtgttggtaggtactgagggaggaagagacacatgtgccctgaggaagtctctgttttgtctccatgcacatttaagtcttttacacatttgagaagggactgggagaggagcatgggggaagggggctggatgtggctggcatcttctaagatttatgaactgctaaatttagaaatgtcattttgttattgccagtgaactgctagcatcttcgtatgagtcactaagaaaaaatagcaatcacctcctttgcaagagctagtatgagtaacacaagatgggttcaattaatcattttaaccactaaattcactctggataaacaaagtgtgtatcagatgatgtgccctagaaaggttgtcatccttacaaaatgctatgctctgcagctatgctcttctcattatcgtattgcaaatagttctctgaaagaaaaaactgttcaaacaaaatattaaacagcattcatttgtcattttccttcggggactaggcagcaacctgctgtggctgaaaatatgtggtcattatgaagctggtattgaattgtttgtttatctttagcaggggagggaggtttcaatgatgttactatttgattggtaatttcaggcacttctgctttctaaaagcgtatcctctgtccagaattgatattaataaatgagtgtgtaaatatgctgtttgtatgtttctttttaatgttcatataattttcagtgtcataagctcttatcacctgaggagtgatggtgagttttattttcttgttagtgtatagggttttatatcacagtgagtcaggttgcttgctctttcagaaacctgaagcatttactataaatggagtgagtcaggatgtctaagatgccttgttcactgatgacagtatgactttcgcaagtagatcagagagagatttcagtgtctgcatgtggtgtgctatctctttcatctggtcacaggaagcagcaggcactttttttttttttaacgtagagaaacctaggttctgtttctcctctttttcctgattctccatcttttctttttttccttcccattttctttctctccatctttttcttgttcttattcttctctgcactggttaataatggattcaggggactaaaaagtgacatgagaaggtaataggctacacacatctactcaaatcccccagacagataagaacctagtccacttaaaagtaacttcagataccatccttatagaaatccatgccatcacttaacaacttttacaaaatcctttattctgctatttaaacctgcttccttttataatgtgcttagagagcacaagaaatttgtcaccattttctgaaacattccttactcagactgcaaaatcactctttcagcctatttaattggaagcagaattaaagcttcattagctttatctctaaactttttatcaatttatggcactcttcagagcctcctttgcagtttttcagatcctctttaagtcagagaatgtagaactgtacatgtgtctccaaaagatatttgcccagggcaagtcaatggtaaagttcaaaaatttttaaaaagccctattcatgttcttcaaactcttatggtcacatttgccaagcagaatatgtttagtaaaggtgaggatttgctagtacaagactctggtaagggagatgacttgactgccaggaaataatacagcatgtagaatagagaaaaaacatggctatccttggatgctaccatgtttatttcatacttaggagaggagaaaaaaagcaaactttgatgaagagcggaaagctgagaatcagtgagagaagtctgttttgttggggttgttacaataacactttgcctgaagaaagtactcaacctggatgtattctgataatattgatttgtgattctttccatctaaagaatccttttggagagttaggtgaggacaggaaagtgcagagatgtttaaggagaagagttagagttagatcaaaatcttacttattcaataaactataaagttgtttttccaggcaaaaggagacaattgcggattttattattgtctgaatgaaggggctttaattgctcagatatactgctatgcttccttgcctcattaagtgcaacagtctgatcttgcagtggggaaaaaaaacaggaagaaaagtaaatggggtaaaaccatgagttaaatagttagcttatagcagtatacatccaaaacgatgtattctgatctgttctctctctctctctctgtgtgtgtgtgtgtgcgcgcgcgtgtatatgtgatctcactttttaaaaaaggtttgctttttatcccttgcttcacaaaaatattgctgaccatccaacacagtaaactaatcgatacataacaaagatagaagccaccatttattcagatcatgctacatgccaggtacttaatatatttaaagtataatatatctagtatactttatgtaattacctaatataattattttatcatttaaatgtattaccatgaatgactaactatatgtcatgctctaagttaaagatacgagccctgtgatggaggcatttctgtcgttattttacagatgaggaaagtgaagtccacagaagagactagctacagtctcacagtttgtcagtggcaaaacttagttttgaattcaagtctctctcacactaaagttgatgtttttcctaacacattcctgttactctgctggacttgtcagatttatctggtatctcaaaagattcatgtaagagaaccagagtttttcatccataacactacctccaagagagataaggacactaaattgcaatgatgtaattaaacatttttggatttttttctatcagagaagcctagagaaggtcatttttctttaaaaaaaaaaaataaataaaaataaataaaagccagagataggcaagagttgcggcttctggaattttaattaccagtctattataaatatgtcatcttggcctataatgagttatcacaatcattaactattgttgcagttattggttgtaaaataaaatgcaaagtctcagctatttaatgtatgattaatacaattcattttattgggctcttacactgtgtttgtgggtttctttctctttctctttttcgtttttttttcccactctgtctctttccttgggcattttatgtgaaccacaaaattacaggtctgtgtcttattgtactttatggttcagtaaattaggccagggtgataacctgagggaatattaataatacttgttttaacaagcctacatttataccattgtcaggagttaattgctcagttatacccctggtgctcaggattactgagtactaaaggatagtggtgggaaggaaagtgttccactttggcaaaatctacttccctaagatttgtgtttctggcagcaaggagatgattaccctgaaatacgtgaccatttattgaaccaaaaatagaaggtgttttatataggcactaagtaatacttctaaggtctgaagtcctatggagcacatacagaaaatgtttgcaagtttataaagtgtctgactctggatatctagtaacctggaaaacactactattttattataaaactgtacaccaggggttctttgtcagaacagctcccgccagatgacaggatttatctcctagaagatgttcttttgttctttgtggtcaggcgcagtggctcacacctgtattctcagcactttgggaagccaagtcgggtggattgctcgagtccaggagttcaagaccagcctgtccaatatggcgaaaccccatcattactaaaagtacaaaaattagccaggtgtggtggcacatacctgtaatcccagctacttgggaggctgagtcaggataatcccttgaactcgggaggtggaggttgcagtgagccgagattgcgccactgtactccaacctgggtgacagagcgagcatctcacaagaaaaaaaaaaaaaggtattttctttgcgagggggaaaaggcagcaaatactttcattttgatcttctctatgctttcctggaggctgaaatgcatctacctgatattggactcagtttcctgagaccaagactatgtgttagggtcagaaaggggaatagctacaaaaatagatgatgagagagattattattagatagtataaccctctggaacttctaggatagtcacatactcacttgtcccgtttaaaagtgtaattaggcattttccaattggtttgctactactttcttattcaatcattatgttgtatgtaagaagagaccaaagctttaatgactttatttattttccttatctgaaataattaaacctatctttcagggaattatgctaactttttgaagtagcatatgtgaaagtcctagcatgtcatccttaagaatatgccatctacatggaatatgtgctaatatgattccttgtaccctgcacccctaaactattaatatatcaatgacttttccccctaagttttagtggaacttccacatcttcaggtgagacctctagacagtaaccaccaaatgattgtgagaggtgaagccagctggacttcctgggtcaagtggggagttggagaacttttctgtctggctagaggattataaatgcaccaatcagcactctggaaaaatgcaccaatcagcactctgtgtctagctaaaggattgtaaaggcaccattcagtactctgtaaaaatgcacaaatcagcactctgtgtctagctaaaggattgtaaatgcaccaatcaccactctgtaaaaacgcaccaatcagcgctctgtgtctagctaaaataaacgcaccaatcagcactctgtaaaatggaccaatcagcgctctgtaaaatggaccaatcagcaggacgtggacggggccaaataagggaataaaagctggccacgcaagctagcagcggcaatcctctcgggtagccttccgctctgtggaagctttgttcttttgctgttcatgataaatcttgctgctgctcactctttgggtccgcactacctttatgagctgtaacactcaacacgagggtctgcggcttcattcctgaagtctgcgagaccaggaacccaccgggaggaacaaacaactctggacacaccacctttaagagctgtgacaatcacttgcgaaagtctgcaacttcactcctgaagtcagcaagaccgtgaacccaccagaaggaagaaactcgggacacatctgaatatctgaaggagaaaacactccagacacaccgtccttaagaactgtaacactcactgcgagggtcagcggcttcattcttgaagtcagtgagaccaagaacccaccggaaggaaccaattctggagacaattggagctttgaaaactatttaactaaattatagtgggttcagtataaaagattgttttcttccctcccttctctttttttttttccttattcctatcctgctatagtattttctgccatgttatgcacgtacatttaaaaaattactcaccaatccaataaaaaacatactgctgccttattgtgccttggaatgtgtgataaatggtatacgatcaccaccgctattggaagtggtagagcaacaggaggtcagaagttgtagtcagactgcttcgagtcttaccctagctttactatttgctggccatgtgggaaaattacctgaaatatctaaacattaatttagaatgtgcaatgaaacatgtacaatgtagaatgttttcacatagaatgtcaaatgaagataatagaagctcaggctgacgacccagattttggggttcaaaccttgactctgccatttacttgttctgtgaacttgggtaagtgatgtaacctctctgtgcctctattttgttttctataaagtagattactgtaaaaattaaatgaattaaaacatgccttatgtttagaaaagcatctggcacacataagtcctcaatcaatgttagtgttcttgttctttgttgcttttattacctatcgttttacattacttagggaaatacatgcaaataataaatacttagtcaatgttaattattatgtgacaggtcctccccttacataattgacacacatttaaagaacaggtcagtatgggataagtattgtctgcatggtacatatgataagcactttgtgagtttagttggagggactatcatttcacagaaatgacagctaaatgtaaagacctcaaaaggctaagtagtggtaaagatgtggagctactagaactctggtataaatgtaaatatggacaattattttgtaaaaagcattcaacaacaatattcagtacctaataaagttcaaactttgtcttatgagctactgactttactcttagatacatacccaggaaaaatgagtgcattttacaacaaaagattcataacagctaaaaactggaaaaaaaattaaaatcagaatgatgagttaggaaaatatgtgaaatattcatatgaaatattataaagtaatgaaaatgatacgtaagttcaacaatatgggtgactctcacaagcataatgttcagtaaagtaagccaggtacaaaaaagcacataccataaggctgtttttatataatattttaaatacgcaaaattccgtggtgacatgtcacaatagtaattgtctttggcgaggtaagtagcaacttggaaagtgcatgagaagggcttctgaggtgccagttatgattttaaaattgcatttactttgtgaaaattgattaaccacaattttatgtgttcttttctttataggttttatttcaataaacactttgaaaaggaataaaatgataaaatcattgattgtttcagatttatctaacaatacaatttcggaaattattctaggttattggttttcaaaggctgaaacaaagtccagtatctgtaccttgaactacctggctttgactacacctaaaatagtaacatatttattaagttcttgaggtttataaatggaaggtttttttttttttaaacccaactgaatagtcttttaaaatattatttaaatggtacaaaattataatagctggaaatgatattttatcctctagcatcattaaaacttcttatgccttgccttttttgaggtggagtacagtaaaaagttctttaaaaaataacacaaaatatagccatcaaaattgacttttgatccactctgagcatatgttaaacctagcaaaaagcatgtaaaccaattcttactttaaagagaatattggttatgaagaggaatcttttagaaggttgaataatttgtcagtgatttgttggctacttacataccttgtaacaaattcaagaaatacattgggattctaacctaaagcctaacgatttactccctaaatgaatctaacctaaatcctaatcatttactccctaaatgaatcagatatattttcattaactggaatacttacacaaatcattgctttgcttggcaggtgcacaatttgagtaccccaggaaccaaactctaaaacagagtttagcatataggatgtttattaaatagtactcttgtaatcaatacctgtgaaaggaagaaagaagtagtcatccgtagagaaacgtcaagttgtgatgtagactcattgacagccatagttgttaccatgagaagttctggagctaggataaccctcagaattgttctaaattggactaatgatctgatatttataatttctcatttattaattttggatgcagtctacccagggaagaggcatttccttgggcaaggagactctttgcagctgagatagtcccttaaagggctgacagctaaagaccgactattgtcagcactcccagattctgggggaacaatttcttcattgaagggatatttgaccaacatgtggtcaaatgtggtgatcccccacagtccatctcttgcctgcttagatccttttcttcataaaatttctggaagcttcccagagactgttttagacatctattcatggagaaaatttataagcaagtttgtgggaagcaataggtactatcaccacagctgccctgggtgtagggggacaagtgatgctcatgatttctttcactatccagtctatattccattcactctctactaccatttctactggagtctaagggctctaagtccctagccaccacacctttctcaggctaaagttgttgctcttgtctattttcacaactaggcaaaggaataccagaggtacccaagtagaccacctgagtgtcacatacattctttcaatcttcactgtgtagcagcaaccccacctcttcctaagcatcatggtctattgcccctgccaagatgatccctgctattcttgcctgctgatctaaagttcccagttggcagtcacagcttacaattcaatgtgacctttgctgtgtcctctggcagaagtgtcctgcctttgggaaccaagacctttaaatttacaaagcctagaatagaaggaataggaaaaataaattcccaagtgggttacttgaagtgatttaagtgagcctacttgttctttttgttcttggttcctagacccatgtattcttcctactgtgaaggggaggcacagttatacatgttactgattcaatgagcataccacagcatggattgtgttgcatcctcataaagtattgcctccaagcgggatttctagtcttccagttaatgagtggtgttgtatgttaaatgattagttcatctcatggtcagaggtttgccttagcacctcctttgctataaactaggtttcctggttggtcattttttcatgtggaatccagtacctaggattccctaagtcttcagacagtcatactgtttgatgtcctgcaagcaaaaaagacaataagaaaagacaaagatggtcttcttgaagcaggctgctctaatggcaactcagcattggcctttattgatgacagttggatatttgtgtttgcagtagcaaaatcagctaacacaaatagcaagatcaattaagttacttagattccaagagattggacccatgtaaagcttccatccttacttccttggccatttcatgtaatcataatgccagctggagtagctgatgacagagactaatatcaactgggcgagtttttgtcttcttcattgttcagtgcttcttccgtggtgggtgctctctagtgagtattagtgtgcaacaaaaaaacttcgtcatacttcatgctctcttccaggtacccattctaaatgcatctactacagaagttcttatgcagtatcttctcctatctttcttcaggctcctaatcacttagccaagccatttgctactgtccttgaattcacatatgctctgaacttgagttaattttatttttttacacaaaatatatgactacattctgccccctacccccaccacaaaccaagaatctgtacattgcaaggattttctctcactattctttcaatgccctcattgagtggggctataatgcagctgctatctaatttcacattttacccatatgcttaactgacccttttatgaacgaatcatgtgctttgtcttccactatttactgagtgtaaggatcctctttttggtaatgggtgtgagctgggggagaggtgcggtggatgacatgggtggtttggtaatttgcttatacagcttgcatggaccctctgatctgcttgagcttagttctagatgtaacacttagaactctcaataaattgttgcaagaatcttctgatcttagagcttagtgagtttgacagaacccagctcatgacagacaggtgtggctcagttatcacttggtgctccatggtcagctacttcatctatggcaggcccagtagtatgtcaacagttgttgtttaaaaggcatgattctgatggaatgctcttgctccagactaccagcaatctgtgttgtgattttctcattgatacttgccatagtctcgaaatggcatcttttctcatcactcataccactaatgtcataaagtctcccaggtttttatgccatggtacttgcaatgcaccatcccatcatatctctagatggtttatgttatgtcataactctaattatagattttcttgccaaaaagggtagtaggagcatgtgttgtcttgagtaatgtctgaatcatcttcaagcaagaggggaatactaccttttcatagagatgtttcatccacttctgcaaacttgcaagatcaaggagaatctggagactctaaatatgcatggacgtcatccctgatgtctctagcttatttggtcctttgccaaacaggatcctgacttgtaaaagatagggtaagtagataggattggacagagggagaagttgatctgtgatacaatcccagtgaaaaactagggcaatgccatgggatgctctaaagctagacagttctctcggaattgtctaagttacactgagatgacccgattttcactgatgattgatgccattacttgtgggccaccctaggaagaagtgtaaacttaaataatgtggctgtggcagtctgcaggtgaggcaattctggaagaggcaaatgcagaaatctgtttaccaagcactcttatgggatgggcaataagttttcattgaaggcgttgctggcaggacatcagagagtctaccagagtaattataaagcattcagtctaactgtgaaggtggggatataaaaaggagtaagcattatattcatttgtttatctttactttcataaaaggattcatactctactagaaggcaaagatattacaaaaacattaaaacactggtttaacaaggggcaatgcgatagagtgaggaaaacgcagtaaattacttgagcatgaaatttagctctgactcttaacaaaatacagaattacaaaggtttacatggtttttgttagctaataaaaggaatcctgggtttttctttttcctagtaaagtaactctttcctgtctttgaactctgagaagacattattgtgagattcattataaaatgcactgaacaatattctagattgtaacttcaaaagttttgtaacaatggcaaaattgttctacctatgattcttattttgccaagcacctgaagtgtagacattgtgtttatcaaaagaagattcacatgctttaaaaacaaaaataacataatcatattcacggttgacatattgtaagaccatttaaagagtttgtattgtacttgttgaagaagtaatttgcagaatgtaagttaggatattattcttcaccaagattaatcaaaaacatttccttcagcaattactttctgagtcttaaatttcagcaccataagagatactcacatgtgtgtttgtatgtgtgaaaaaggtacacctcagcatagggttgttaattaatttctttaaagttaacttgattcaatttattgttgactaagtgcaattctaggctaaaaatgtgtgattagataggaaagatgtcctgtctaaaagatgtccaaacagactatttgttttcaagaagttatagtcttgtaaggaaagtaagaaagacaaatataaatgctaatagtttcacaataaaaaagtacttatgatggtcaaattaaaaagaaaagatagtaactggggatattattaaatattttaggaagagggaaacatccaaaataggtcttaaaatgtgcctagtatatagcaagccttcaataaatattaccattattactggtgagtttttccttaattgatacctatctgaatactaatggaaaagtttataacattggctgaacactgcgcttttgaaaacttaatcacattttttccttaaggcaacatcaaattgatgaattttgtcttcattttttagaaggaaggaaggagggaaagaagggagggagggagggaggaaagaaaacaaataaacgtctctgaaagagatgaaagtaattttcccgcgccacacaagttagtagacttaagaccagggatctaaatataaggttgtctgtctacagagtccaatctcttttaccacagtcttctattacttctagaaattgttatcaattatgaacaattattccaaattatttactgtgaaaagagtaattgtttcggaatacacaatattgttcttgcagaagagaattgtaggaagaagcctctctccctttgctgcctttcagtcagcctactttactgaaggcttcaaaatgttattttttttcacgtatttagagactgaaaagagttatattatgatttcaatgatttactcagaccacaaataaccatattatgaaaagggcctaaaagaaaaagttatatatccatctataaccactgattcagggcagttctctcacttgcaattgaataatgattgcttcatctctacatgctttacattatttaggattttaaattactaatatgtgaattcctttttatttactaagatggaatgaatgccaaaatttctcttctggaaacttgtgtatcactcaagataagatattgatttttgaactttgtagtacttaaatttttagagctgtggaattttaaagggcttttgcaaaatgaaaacaatgcaaccctgagaagtaggtcataaaacaacaataaacaatacccctacaagatgctgcagttgtgggatgaactggtaataaggaaacaatggagaagggaccaagaaggtagaaagagagacgagggtagtggtcagtacattaaaatgaaaattaaacacctgactgaaaatttgtatcttgtgacatttgtgcttgcacatgctcaacttaaacttatttctgaagatttatacatttatatgaagttgattgatgatattttatgcccatgggagtttggaatcaagcaattcaataactgcataatgctcagtataacaaatataatcctggctatgaaagtcttttttctatgttttctaaaatgaaagtctttcaacggcttctaaaatgaaagtctttctatggcttctaaaatgaaagcacattgcaaaggaaattccattctagcaagtgagattctgttctgatctactgatccataaattatcacagtgacaattatggactcaaataatggtctcaaaagtctttcctagaaccttaataggtttatttaatccctctagaaaaaatggagatttgggaattaaaagccaatagattagctggaaattcataactattaaacgcccaatgtattccatgtttgtgttcttttttcttttacccaaattcaatgtttgctaataaaatagtatgagatttttacttcagtacagaaccacttacgcaatctggccctgtacattagctacttccttctcaactctgtatttactttgcttcttattatattatattatattacttactttgcattaaaaagcagacatggccatcaaccactaattccttttcttagtattgagtttactaagtgaaaccaatatgaagtgaagaaatggcttgacatgtaattactacaaattactatcaactactaaacattactacgaattacctgacaaatggactaatgctgtatttgataataagaatttcaatgagtaattttactttaatttattaattagactgccttttgggtataattgtctcctcttcaggcagtctcagcagaaagttacatggccaaatgaattcggagattcaaatcctgcctcctatttggaggaatgtaagtgagaaaacggagaccatcctatggaggtagtagatttttggttattttctccaagaaagttgttgtaatatttcttttcttaatcttccatgtctttaacaaatctattatttaataaaggcaatggagcatggtagaaagaattggaagtttaagaaccatggtcccagtcataattctttcactataaaatattgcacctacgaaagtataaggcacttttctcctctgtactcatttctccatttgcagagagaagagtgtattattaactcttttttattacgactaaaattaaccctacccaaaataattcaagcataaaaaatgatttatttgctcagaaaaccaaggtacaagaatggccaaaacaagccaaattcaccagaatgctctctctctatctttttctttctcttgctttgagtgtgtgtgtgtgtgtgtgtgtgtgtgtgtgtgtgcactatttctggttgctttttcttagtctatgttaacttcattctcagcaaggaatttaccatatggtaacctttaaaatgcacaggttttcttacaaccaaaaattccagcctaaaagttttccccaaatccctgagacttaggttctgtagccagagagatggagtgtactaatgagttaacacagcatcacctaacaagactaattaaatagtgggctgagagtaggaaacttgaaagtcccttgggaaaacagaagtcctgctatgagataaatgtggagtgaatgctggacacacaaaataacagatgtatattgtaacagggctggaagagatttccattcttccattcactcatttgttctcttaaagaactgtaatacaatattggtcaagactgacatggtctttgtcttcatgcaacatacaataaatggaagagagatatattaaaatgaaaatctataaagctatgtaattatatgtaacatctcttattctatgatgcttagcttggcactcttttcagcatctagtaaactcatttctcacttgcctataacattatttctaatttctcacagatcattggccttatgctaatttgtactactgttttcagactttggagggagtcagttgcctgtagccatctttcatcatacaagattaaggaatacttacagagagtgagttccatacccaaagcatttagtgtggcacaatttggcacaaagtgggagccaaaaacaaattgttactgtcttggtaactacacaactaaattctttctttctcagaaattgatattgtctatattagctatttcatgaaattactgacagagttggttgatatttttcggaatgggtgaataacacattttgcttcttttgtttttctaagaaagacttggagtcttttcttaacattagagattcacccagtgtctttgatacattggtagttatttttgtcattttgtaatgtttgtacttttgagacttttcacgaaggcaaatctgtgtgtttggtgggcaatttgctgctaacctttcctaactaatatgactggattattgtccttttttaatcagtataaatcgccatgaagaatatgtgaatttctaaaggtagaccggaaaatatttttataaaatagcatcatcctcttggtcaaagtaggattatagggacaaacaatcatcttgaaaagttacacagtagaatttgggtaccaatgtttccaatttttggtgagacagtgggagtttagagagggatgaaacatcatgacaacttggctgatacagaacaatcttctagttgatacttggcatataagaattggcacacctatttggaactgagagttaatagaaaagtttttaaaatgcttaaactttatggaaattcttcaaaaaggtatctttaagctaagaccatcaggggttcttcctgcattaagaggattcatagttggcacacagacaactttttgagaatgtgcaataaagacatcacatcttttggtcaaacacatttcaaaaggcatttctccttggttagatgcaactcctgcaagtacatcagtcctacttactgccttgaactgaggcaataaaattttggcttgtagattttaggtcttggtttcaaaatttaattttagcagagagatcttgagctagctacttcatttcacaaacctcactttttctaatctgtaaaatgagataactatacttattttataaatcgtgtacattaaagagtaatgtaggtaaattgtctgtcacatggtctgccaacatccagaccaagcactcaatgaatgaatactagctctgattttattattttgtttgtaataataataataatggtaatagtatagtattattgctttattttaatctctcgggtcatatatcaaatgattgctcataatttttttaaccttacttttacccagttgtcagttccatgactgggtattttaataattcttattgagaagattggaggaatgaagtaagactaaagctataattggttaaaaaaagaaaaaaaaaaagaaaaatccagcaggcattcatattagctagaacaaagaatattttgtcacttctgtgtaatatttatagaatggttttagcttaatccaccatgatcacagagtggacttgtctaaagtcgttttacataaacaattctgtaaattgtttatgtacaacagaagaacagcatagcctttctgtgagcgtgcgggctcctcctggctgagaggttgcttttctctttctcactgtgcagtataccacattgctgcaagctattgtacaacaaaatcatgtccaagggggtgaccaggatagtgaaggatttaaaaacaatattttatgaataatgctttaaagaatttgaattaggattgaggattttagccacagagaagtggatcattgagattgactaactgacaactatttccaaatatgtgaaggttggtcacatatatgaggtatgtctacggttgctactaagttgaatggaagtttttcaaaaataggaaagctatcatttattgttaaactgtaagacatataaagcagaaaaatgagtagttctttttcatgatgggatatgctgtcactggatgtattcataaagagtctggataaactgctggagctattatggtgggacagcaattcattaaattgcattggattacactatatatcttaaattctctggctatagaaacaggtaagatgaaatacaaagatagactcctggatgactaaggctcaaactcagacttttgttttatttcattaaaacagaaaatattccacttctctcaatgtccaatctgttccattctccatctgactttctctgagtagacacagatgagctataatcagggatttgtaattcttctgtaatgacaaatacattaacattctccctgccaatgacaatactgcaaattaatgcttgtccaaatttcattcatttactgaagggcaagttggaaatggtccaaggttttaaaactgccataaccatttgggtaagctgtcaataagctttccaggaactctgagcttgacttaattgagaagagtagttttttgcctgctctgctctttggatgtctgggaatgggtgaccttttgaatcacttcttttttgtttgttttttttttctcactttcaagacttttttttttctatttttattattatactttaagttttagggtacatgtgcacattgtgcaggttagttagatatgtatacatgtgcaatgctggtgcactgcacccactaactcgtcatctagcattaggtatatctcccaatgctatccctccccccaccccccaccccacaacagagcccagagtgtattattccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacacgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatgtccttcacccactttttgatggggttgtttttcccttcttgtaaatttgtttgagttcattgtagattctggatattagccctttgtcagatgagtaggttgtgaaaattttctcctattttgtgggttgcctgttcactctgatggtagtttcttttgctgtacagaagctctttagtttaattagatcccatttgtcaattttgtcttttgttgccattgcttttggtgttttagatgcgaagtccttgcccatgcctatgacctgaatggtaatgcctaggttttcttctagggtttttatggttttaggtctaacgtttaagtctttaatccatcttgaattgatttttgtataaggtataaggaagggatccagtttcagctttctacatatggctagccagttttcccagcaccatttattaaatagggaatcctttccccattgcttgtttttctcaggtttgtcaaagatcagatagctgtagatatgtggcattatttctgagggctctgttctgttccattgatctatatctctgttttgataccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggacattttcacgatattgattcttcctacccatgagcatggaatgttcttccatgtgtttgtatcctcttttatttcattgagcagtggtttgtagttctccttgaagaggtccttcacatgccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaattcgacttcctcttttcctaactgaataccatttatttccttctcctgcctaattgccctggccagaacctccaacactatgttgaataggagtggtgagagaaggcatccctgtattgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgtatctattgagataatcaggtggtttttgtctttggttctgtttatatgctggattacatttattgatttgcgtatattgaaccagccttgcatcccagggatgaagcccacttgatcatggtggataagctttttgatgtgctgctagatttggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtatctctggtagaattcggctgtgagtccatctggtcctggactctttttggttggtaagctattgattattgccacaatttcagatcctgttattggtttattcagagattcagcttcctggtttagtcttgggacagtgtatgtgtcgaggaatttatccatttcttctagattttctagtttatttgcgtagaggtgtttgtagtattctctgatggtagtttgtatttctgtgggatcggtgatgatttcccctttatcattttttattgcatctatttgattcttctctctttttttctttattagtcttgctagtggtctatcaattttgttgatcctttcaaaaaacgagctcctggattcattaattttttcaagggttttccgtgtctctatttccttcagttctgctctgattttagttatttcttgccttctgctagcttttgaatgtgtttgctcttgcttttctagttcttttaattgtgatgtttgaatcacttattgatcagtcatttataagatttttcaggatggcagcaaatggaaatggagaccttaagggaaaaatttgaaagtcatcttttaaattctaaataactttgggatttaaatatctctctttattacaatgtaagttttaaaatgaacattagttcaaatatttggaggatgctgatgagatcctgttgtcagaatgcctatccctggcgttgaataggcagttgacaatggggaactgggaggaactccactgggctggttaatgaaggacttaatgaatctgaccctttttatattgtgctatttgatttggccaccagagcaattgccattttcacttgactgctttcattcctatcttatccatatttgtgtttcttatatttctgatcacagagtcactgagataaaaaatggattttagagaagacattgaaatttactattaaatgacagtccataaagattctttggggtatttttatcatcattcacacttctgagagggtcttgagagtgaccagtcctatacgctggtgacactcataaagccctccctctaaaaggagttcccctacaattgatgccactctcctcattgtaccttgcacagtgatcgtcaaatagtaatagtataacacatataataagtgctagttaaatacattttgggattatctgcataaacaatattttcaccttttgtttttatttacattgctatttgtgagattgtaagactatctaaatagctatatgtaattttccttagacttccctaattttcacttttcctaactaaaatgtaacaatattgcatgaataaaattactatgactacttttctattaataaagtctaaatgttcccatgctatcttgagaagtaaaatgtgtgctgctctgtaaagcagcaaactgggcgtcattgctgggaaacatcaagacacctaaaatcaaactgcttaattctcaccagtcataaaattcaatgacgataaatgttaaattccccaaatcaaggtcaccatgattatccaaacaggtcgctgtggaataataattaatcctgaggacttggtgctagaccactaagattcctatggagtgtgacttcagacttctccttgtgcttccatttctgtaggtataaatatagacaattttaccaacttcacagagtgtctgtggagattaaatgacataacagtgtaaggtatttagaacaatgcctggcacattgtaggtcttcagtatatgttagatagtgataatatatatgaaaagttttaaaatttcaaaaaaatccaaacttttagtcctataactataacgaatcctctttagaacagtggtaaggatgtggtacatgtacaataacaacagcaggacagagctagtaattcaattgtctctggagaatcctagaaacatcatgcatattgctcgtaactaacatatctgtcacagacattgtgactaccataattggattcctcatgtccatttttctgcaggacaaaaagaaagtatagactcaccctattcagaaaacaccactcagcacggaaaatgtgaagagaaaaacagagagacccattgtcagtagaagtcagtgcattgtgactttgacatgagaaagcataaacagtaaccaaaacagcaataagtagagaaaagttattctgggctctaagaagaactgaagtctgaccaacagagggacatatcaattacaagtcaaatgaatctgctttaggacaaaacttaaaggagtaaaattcaagcttttaaggaaattagacttttaacaactgaagctgtttttccccttcagactgaaaataggaagcaagatttagaagcacattttacttgtatatcctctcacgaagtcgattaaatcgaaccttgataggggaaagaagcaaaaagttcaatactagcatcaaacaactgtagagaacagcagagaagcaaatagaaaaagaaaaagaagatatatggtattttagaaggaagaagagggaagttgaagaaagaggtagaagagaagggaagaatgtaagaataaaataaatgaaacaggagatttgggggaaaatcattctcttttagtagcagggagaatgagactaatgatgcaggggaaaatgacagaacatgaaaaaaaaaaacttaaacctaaatgttccacctgtgcaattgtacccaattgatctgtcagtttttaaaagctaagtaaaatgtgttgtgagggatacactggggggtatgcatctgagtcagtggcgattcacaaccacagtgggatatcagtgaattgagctggttggaggtcctatctcttagattagacataaagaatcatggttattaaaagtcccatagtattttggctaacataaagaagttaattttgtacattgggcagattccagcaaagaaattatgtctatgtccacatagggagtatgtgtgtgtgcacatacgggggtgtgtgtgtgtgttttaaataaactttgtgttgcagccatggaaaactatcctcctctccctattttcttaactggtaagggaatttttcttctctttgatgttttagtattgataaaagcagaaaatcacaatacctaaagttgcacttccaaataatattcagaaactctttagagtttaatctttttgaaaagctactaaaacttgaattactgtttccctcttcagggtattttaagaaatcaaacaagtatttttttattatgtaaaaataattctaataaaatttgattctagaatgtttatttaaaatgatgctagaggatgtaaatcatttgttcatattctaaaataagtgatctttagtagataaatataaattttcttaatttggtttctaaatgtttgtcaaaaccaggcacacattcatttattcacaattcaaaatatagtgcagtatgtcaggccttcaaacttaggagataggatcatttaggcacaaattctgccctttagacattcagactatcaagatatttataggagggccgggtgcggtggctcatgcctgtaatcccagcactttgggaggccgaggtgggcagatcacgaggtcaggagatcaagaccatcctcgctaacacagtgaaaccctgtctctactaaaaatacaaaaaattagccgggcgtggtggcgggtgcctgtaatcccagctacttgggaggctgaggcaggagaatggtgtgaacccaggaggcagagcttgcagtgaaccaagatcgtgccactgcactccagcctgggtgacagagtgagactccatctcaaaaaaaaaaacaaacaaacaaaaaaaaaaaacaaaaaaaaaaaaaacaagatattggtaggaataattgctgaacatctgtttttggtaagatggtatatgaaataaacagataaatttctataaaagtacctaaaaatgttttacatagtgtaatgttttcaaatatgtatcagaattcaagtgaatccctcaaagaacacaagtgacaagagacaatatatagtgctaagagaatgctggagtcaagcttacctctagagatatctaccatctgtaagggacttagaggctggattttaacagcccttgggctgatcacagggaaaaaaaggggaggtctggagcttgagcagatccgagagagaactaacaatggaaaattaacaatagttaaagtaacacttaccaatactttgagagcagctaatgtgatttttgaggaaaatttatagccctaagaggtttattggtatttttaaaaaggctaaaagctaatgtgctagtaattgacttaagaaacaacaacaacaaaacacctaaggaaaaggaaaagcaaagaaactataagaaatgaaacagtaaagaacagaaattactgggaacaatataatagggtgtcatcaaaggcagaagttggttccttgctaaaactaataaagatgatgaaccttaggcaagactgagcaagaaaaaaagagaaagcaagagaaaataaatgatattaaggagtaaaaaggagacaaaactcaatatgaaaaaaagttaaaatgagattaatagagccgactttatgtccataaattttcccatttcacctgaaaaactgtaaaacacccaaatgaactcaattattatatctgtgctatatatccattgtcagataaataccttattacatattagatttatttaacctttatttcatctagttctataataaatatatacataataccactagatcttatgttggtgcctttttacttttctgttgtctgaacttcattctagatggattactcaagaagggcttatagaaatcatatttcttgagtttttgactgttaaaaatactttgtgccctttcacttgaatgtcactatttctagttataaaatgttgggctcccattttctttccttgagtatcttaaacatctcaattttcttctaatatgaaatattgctattaaaaatccagtaacaatctattttttcttataatttgttctttttatttatatgcctaaatgagttttatgtaaagtcaactacgtttaataggctatgactcaatgttggttgttgtagtcagtattttcaggtatgcagctatgcattttattatgtaatttctattttacactagcataaaattcacagctttaaccatttttaagttgtacaattcagtggtttttagtacttcacaaggttacaaaaccacaactactttctaatccaagaatatttttatcatcccaaaataaacctgacagccattaagctaccacttctcattccactctcctcttagcccccgcccaccactaatctgctttccacctctatgaatttgattaatctgtacaaatgaaatcatacaatatgtggacttttatgtctgtctttgttttctttagcataatgtttcaaggttcatgcagattgtggcatgtatcagtacttcattcctttatgtggctaagtaattttccattatatgcatatacaatattttatataaccattcattattagatgaacatttgggtcatttccacatttttgttgttataaataatgctgctgtaaatgtttaggtacaagcttttgttttcaattcccattgatatacagcaataattggaatagtgaggatcatcaaattcttccacaacagctgcaccattttgtgttcccaccagaaatatagtagagttgcaattttttcatatccacgtatttttcttgttcttttttctttaaattatggcatcctcatgaatgtgaagttgtatctcgttatggttttaatttgcatttcatcaatgagtaatgatattgagcatcttttcatgctcttattggcgatttatatgtcttcttgagataaatatctactcaatatttttgcccattttagaatttggctttcttatttgttgttggattatgtaagttatttatatattttggatttttgcaaatattatctcccattctatgaattgtcttttcaccttcctaacagtttttttaatgcacaaacattttaaattttgttaaagtctaattatcatatttttcttctttagttgcttgtccttttgggtcatctctaggaagccattgccaaatacaaggtcataaatatttacctcacattttcttcgaagagttttatagtttaagctcttatattgaattgatttttacaagcggcatgaaaaagatgtccaaatttattcttttgtatgtgaatatccagatatcccagcaccatttgttgaaagtgttattatttcccagttgaatcgtgtcttagtccattttgtgatggtatgatgaataccatagattacgtaattcataagaacagaaatttgttatctcacaattctggaggctggaagtctaagatcaaagagctacatgcggcaagagccttctttatgcatcatcccatggtgaaagggcaaagagaaggggagagagagaataaaaggagagagtgaaaatgtcaaaatcttttaataatggctaaataataaaccctatcaataacaaaccctctcttgcaatggcagcattaattcattcactctgtcttcatggcctaatcacctctcattaggccccacctcccaacactattacattagggattacatttccaacacatgctaattggaggacacattcaaaccatagaaaattttcttggggctgggagcggtggctcattcctgttcctggcactttaggagggtaaggctggaaaatcccttgagcccaggagttcacgactagcctgggcaacatggtgaacccagtatctacaaaaaattagtgaagtgtgacagcatgtgcctgttgtctcagctactcaggaggctgaggtgggaggatcacctgagcctgggaggtagaggctgcagtgagccttgattgtgccactgcactccagcctgggtaacagagtaagaactcatctcaaaaaaaaagaaaattttcttggcatgtttgtcaaaaataagttgatcatagatgccaattttctgtattctcctttctattccattgttctctatatctattcttatgataatatcacactgatttgattattgttgatttatagtaagttttggaatccggaagtatgagtccccagctctgttattttttatcaagagagttttgctattctgtgttccttgaagaaattccatatgaattttagcatatgcacgttcgtttctacaaaaaggcagtaaatatgatatagactgcattaaatctgtacatcaatttggggagaatactaatcttaacaatattgtgtattccaattcataccacatgatgtctttcaatttatttaggttttttaaaatctactttcatagtgttttacagtactcagtgtacatatcttgtaacttgttcattagatctatttgtaagtattttaggtttttaatagtatttaaatggatttttcattaatttccttattggaatgctaattgctaatgtatagaaatacaattgactttagtatgctgatcttatatcctgatactttgttacatgtgctaattcactctaacctatttttttctgtacatgcagtctttagggttttctgtgtaaaaatcacatcatctttagatagaaagttttatttcttttttctcaattaaatatattttattttttcttttataatttcatttctagagcttccagtacaatgtaggatagaattggcaagagtcaacctccttgacttgtttttgatctttaggagaaatcttaacccttacccattaagcataatgttaactgctagtttttcataaataccccacaggaagacaagtccctgaataattttgactgacctaagtaggttttctccctcttttatgcataatgtactgagaatgcaaatttctgaaataatgaagaaatgtttgaaacaacttggactatgtccttgtttcctccagaacagaatattctgcaatgcttgagctcaacaatcgaagttgtgtccagggtataaaacacagagctgagtggtttcatgatccttcagatatagtatgactggggacatgaacagaaaaagctccatgtccctgggcagctttcctgagacttaggggacttattcaccagggttccttggcttctgtttatacttggtgcctctcattaatagaggtgctttgcctgccttgttgtgcaagtgttctgtctctcagactcatgcaagtagtaaagatactggggcttcttttgctgctcacaggtgctctcatgaaactgggactgctgtggcaactgggtctgttttttggtccatccacacctaaaaacccttgcagaaattagtgtaaacctttccataccctttactgatttaaggaagttttcttctatgtttagttgattgtgtgcttttttttttttttatcgtaaatgagttttggattttttcaaatcctttttctacattaattgaagtaattgtgtggatttttatggtatattacatacattgacttttctatgttgaaccacctttgcgttcttgaaatacattccactgggttatgatgtataatccttttaacatgatgccaaatataacttgctagcattttgttggaggttattatatctatattcataaggtatattggtcttcaatttccttttctaatgatgtcattgtctgacttagaagtgaagataacactggcttcatgaatgacttgaaaatttttccctccacatatagtttggctgtgtctccacccaaatctcatcttgaattgtaactcccacaattcccatgtgtcatgggaggaacctggtaggaggtgattgaattatgggagagggtctttcctgcactgttctcatgatagtgaatgggtctcatgaggtctgatggttttaaaaaatcagggtttccctgtacaagttctcttctcttatctgctgccatgtgaaatgtgtctttcacctgccaccatgattgtaaggcctacgcagaaacgtggaactgtaaatccatcaaacctctttcttttgtaaactgcccagtcttgggtatgtatttatcagcagcaaggaaacagactaatacagtaaattggtaccagtagagtggggcacttctgaaaagacacccaaaaatgtggtagtgactttggaactgggtaacaggcagagattggaacagtttggagggctcagaagaagacaggaaaatgtgggaaagtttgaaacttcctagagacttgttgaatagctttgacaaaaatgcttacaataatatggacaatgaaattcaggctgaggtggtcaaagagggagatgaggaacttgttgggaactggagcaaaggtgactcttgttatgttttagcaaagagactggcagcattttgcccctggcctagagatttgtggaacttggaacttgaaagagatgatttaggatatctgagagaggatatttctaagcaaaaaagcattcaagatgtgactttggtgctgttaaaggcattcagttttacaaaagaagcagagcataaaagtggaaatttgcagcctgacattgcaatagaaaagaaaatcccattttcaaaggaggaattcaagccagctgcagaaatttgcataagtaacaaagagctgaacgttaacccccaagacaatggggaaaaggtttccagagcatgttagaggtcttagcagcagcccctctcatcacaagactggaggcctaggaggagaaaatggttctgtgggcttgcccataggttactctgcagtgtgcagcctagggacttggtaccctgtgtcccagtcactccagccattgctgaaaggggccaatgtagagcttgggctgtggcctcagaggatgcaagcctcaaactttgacagcttccgcattgtgttgagtctgccagtgcaaagaagtcaagaattgcgatttgggaacctctgcctagatttcagagtatatatggaaatgcctaaatgtctaggcagaagtttgctgcaggggaggggctctcatggagaaactctgctagggcagtgcagaagggaaatgtgaggttggagcccccacacagagtccctactggggcaacacgtagtggaactgcgagaagagggccatatcctccagaacccagaatgatagattcaccaacttcttgcatcgtgtacctggaaaagctgcagacactcaatgccagcccataaaagcagctgagagggaggctgttccctgaaaacccacagggacagagctccacaagaccatgggaacccacctcttgatcagcatgatctggatgagagacatggaatctaaggagatcattttggagctttaagaattgactgccctgctggattatggacttgcatggggccttgtagcccctttgttttggccagtttctcccatttggaacagctatatttacccaatgcttgtacccccattgtatctaggaagtaactaacttgcttctgattttacaggctcataggtggaagggacttgcgttgtctcagaaaagactttagactgtgggcttttgggttaatgctgaaatgagttaagactttggggcacagttgggaagacatgattggttttgaaatgtgagaagatgaggtttggtgggtccaggagcagaatgatatgctttggctgtgtccccacacaaatcccatcttgaattgtaactcccacaattcctatgtgccaggggaggaagtcagtgggaggtgattgaattgagtggggggagggcgggtctttcctgtgctgttcttatgatactaaatgagccttacaagagccaatggttttaaaaaacgggagtttccctgcacaagctttgcctctgccattcacgtaagatgtgacttgctcctccttgcattctgccatgattgtgaggcctccccagccatgtggaactataagtccaattaaacctctttcttttgtaagttgcccagactcaggtatctctttatcagcagcattaaaacagactaatacatctcctattctattttttgcaaaaacttgagaggaagtggtgttaattctttagatctttagtagaatttatcattgaaagcatcttgtcttaggcttttctttgttggaagtttttattattatctttactatttactacatctatttaaatagatcttgtaatcagtactggtcatgtttttctttgtcccttgtaacaaatttgacttaaagtctagtttgcctggtattagtatagccactctggctcagtatagtcactcatggaatatgtttttcatacttcggtttacaaactacttgtgtctttatatttaaagtgaatctctgacaaacagcatatagttggattattttagctcatcttatgaaggtatcttttaattatagagtttaatatatctaaaatgtaattaattataatgaatataattattaataaggaataagttatttttcccattttgttatttgctttctatatcttgtacttttatttttgtctcacaacacatcccttgctgccttctcttatgttagataactattttaagtgttccattttaattcctttcttattacctttactaaatgatttctggttatttcttagtggatcctttggagattacaaaagaaatcctaatttataacaacattattatatcatttgaattaatgtcatatagtgtacactagttactttcttcctgtctcccctttattgatttttatgccacaaattccatttttatttatagtgtgcccattaacatagatttatgatgactgttttgtttaactgtttttttaaaatcaagaaggacaagaaaaagaattacaaaccgaaattatattaatactgaattttatatttacctgtgtagttgccttttgtgtggattgcctttattcttttgtgtggatttcagctacagcctagtgtactttcactttagtttaaaggactccttttagtatttcttataaggcatatctaccagaaacacacttttagtttgtgtgtctgtgggaatatcttacttccttcttcatttgtgaagtcggttttagccaaatacagaattctttgttgattttttttttcctttcagcgctttaaatatgccttcccacagtcttctggctttcatagttttttttttttttttttttttttttttttttttaatgagaattcagctgttaatcttatggtgaatcccttgtatatgatgagtctctgctctcttgctggttttaggtttctttttgggtttattttcagttttgatctttttgcgtttatgcaccttgacattaattaagtttcttgtatatgcagattcaggtatttcaccaaatctgagaaattcagtcattatttctttctttctttttcttttttctttttttcttttttttgagacggagtctcactctgttgcccaggctggagtgcagtggtgcgatcttggcttactgcaacctctgcctcccatgttcgagtgattctcctgcctcagcctcctgagtagctgggattacaggcatgtgccaccacacccagctaatttttgtatttttagtagagacgagatttcaccatattggccaggctagtctcaaactactgacctcaagtgatccacctgcctcagcctcccaaagtgctggaattacaggcgtgagccaccacacctggcctagttctttaaatattccttctgccgctttttttttttttcgtctctcctctcttcctagaactaacattatggatatttttgtatgcttggtatcccacaggtttcttaggctctctatttttctttattatttttcctttatggtcctctgacctgggaatctcatttgatctaccttcaaatcttccctataccttttcaaatcttctgaattcctctggtgaattttttattttagttatatttttctacaccagaatttctatttggtttcttttcaaaatttctatctgtttatgggtattctctgcttggtgagacattgttctgatgacttcctttatttgtttgtctatgattttcttcagccatgttagtatatttaaaatagttgattatacattttagatgagatattaaaaatatacataaaataaaatagttgactaagtcttggtctagtaaattcaatgtccaggctttctcaggaaaaatttttgataatttctatttgtatttttggtatatgggttatatactcttatttcctttcataacttataattattttcttgaagaggggatattttgaatattattatgtaacaactctcaggatcatgttctcctcctccccagaggtttatgttcttcatattgacattgttttgcctgagtgtcaagtggattttctgcactaattttgtaaagtctaaatttcttctttgtgttccttaaaatctccatttcattatattgttggtcagcttgtgatttaatagtgatttccttaaacttgtagaaacaacaacaacaaaacaccaaaaccccagtctttgaagatagtctctgtttctgtgttggagcacatgtttcacattcagacaggaagactgcaattctgcctaatgctttacttctgattgagtagagttcaagtcacagtgagagcttggggccttaacccattttttctgaacatgtatgttgtagcctcagaggttctcagtagtatgtggaagatttttaattcccttattaccagaagcatctaattttctaagctttcctcccaaacttttagctttgtctattgcttaccccaactgttatcccttgccctaggtggcaatgaataatgcatttgtttaaaatatttttttcctggtagccacttcagtactgggagagttcagagttcagtaaaataaagacaagcctagtggtccttcagggagccagcagatgtatcaaaacaaagtcatacttttttgaaaatgagatttattttgctccccctagtgctaggcacctataacctatatcaaaaatgagaattgttgtgctcaaagttgctgcacaggtgggagacgctgcccagagaaattaagactccacaaacgtatactagcaagaatcaagtttcttgtttttcttttcttaattaagcattttcctgattactaaaacctatgatgagtttttccagagttctaataaagttgcttctgacagtgcttaccagtttcttcactttttttatgcaaggacagtcttttgtaattccttattcagccattttcactgatgtcacctcaatttgtttaattattcaggaaagttactaaaattataattggttttatttattgtgttcctttgttttgtatttattcctgaaaacattattacctattttggatttttttactaccttctgtaattattacttatctcaaatccatttttaaagcaatttttcaatttctttttgatttttaaaattttcatccatttgactatttctattaaggctttaatcttttgtatttattggtttttttcattctctctagtttggttttcataaccagaaatatcctttctaattatgtcctgagttgcatagtctcattttgaattttgaataattcttatttaccttctttcatgttttgtaccagagctttaatgtgttttagctattctggaatgatccttggccattcagttttgatgactgattcagcccctttacatctttttaaacacacttgcacttacccacatttccagtaggtaaaactctccaattttagttgctgcacacaactaaaatctacaccattgtggttttaaataaatacctgttggtcatttggatttttttccattctcaagtatttcagattcccacttgctttcttgtgctttctcccctccagacagtgatagtaggctggacttctggctgttgttgtgatttctttttccaattcacttattttggggttcatcaggcacctcttaactaaattttattaacaggttgcccataaattcctgactttcacatttagttgctgagtctgtttttgtctggggatccaaggatattgaaaaactatgacccctgccatcaacttcgcagaatccccattcattcttatttgatgtttatccatatatttcataaacacatcttaactaatattgataaagttaaaaaatagattattggcaggtaaactgatatggattaaccttcatcagtttaccactattaacaccaaagttcatttgcaatattttattttgtacactgtgataagttaattttgatatcacctgtcatttattatagatatgaattatattttaatatgtaaaatatatttcaatatatggaatatagataatatatttatatatatatgaaataacatatgaccccaagattgatgtatatatatgtgtctgtacatagcaagctatttgcttcctctagggggagcaaaacttaaaattatttttaaattttaaaagaaatgtattgattctcattaatacactgatatttttataatttgagaacaacattttctgctttaaatagtagctttttatacaaagttttgaatagcgacatattttaaaatgactagatattcatgcacataaatattcatctggacaaaaaaatttaagactccaaagaaatttttcagctgcttagagagaattttatggcttgacactgtagtttttctgttgccttcttaaattttcccttatagttatataacctactttatggaaaagctgccacagagtcagaaagctactagataatgacagaaaaaattgcatagtttccacttcactaagctcagagatgaaagttaaatattgtttttgtgttctagtcgtgtataaacttactatcacagaacacactctgcccaaatattactatgctattttggcaatagcactggtaatgttctccactgaatagtaaaatatttcagagtctctatgagcttaatatttcaaacctttaaaaactaaaggaaaaagaaataactttaaatagttttgttaatacaacgacatgaacaggttttgtaattttgattaagtgttttagaaaatgtttcatgggagatgactaccttgaatatgagatgactaccttgaatacatatgctctgggtttgatcaggtttttataaaaccttgaaaagcatataactatgttttatcgtagtggattaactgtcaagcaaatcacttgatgtgttttgatgttttatacagaccactatactgtctcttgggcagcaatactaacaacagaaaatatgcagaaacagagatttgttaagaacacatatatgcttcttgaattattcaggttttaaaatgatgctccaagcataccattttcaatactctgcaatgtgttctgttgacatttgctaaaattttgtcatgtatttttttcatctcataaaaataagtgaatattcaacttttccttctttatattatttttgtgagaaatgagatcctttatggtgagactgtgtcactacttgtattatattacactcactgaacacaatttttctcatttaaaaaatgaagattaaaatacatagagttaataaaattgctcaacactatgtcaaaaataagctagattatataaaaaacattagtttcttccatctttcctctacataataaaatatttataaccaatttttgcagtataatcatcctgcactataatctacaatatctcccaaagagcaagtctttgtttctgtgtagacaggcatttgcattttttagacatctgattataatcagtactctatttattcttactatataacattaggtgcttccatagacttgtttactacctttgaagttaatcagagaaggggtaattttgccaatcaagtacctcagtagggtatatcttaattttctgatttgtacatcaaaaattgatctatcaaaaacaagctttaaatttggtaaagaagaagacgttattgttgcagatgctgaaaaactatattaaagaacgtaatcttctgtcctaaaaaagacgcaaatatcgtgactctgtaaatatgtctttcacatgccaggcgcagtggcttacacctataatcctagcattttgggaggccaaggcgagtggatcatttgaggtcaggagtttgagaccagctagaccaacatgaggaaccccacctcaactaaaatttaaaaaaactaatttacttcataaatttaccttttctatacagttgttataaatagatacaacaagacaatatttagtctcttatgtttgacttctttcatgtagcacaacatttctgagttttacccatgacacagcaagggtcagtatttgcttcatttttatcactaaataatactccattctatggatataccacatattgttcatttatcaactgataggcattagattatttccagtttttgtttttcaatattccacttggtagaactctcttagcatacagaatttttacatcttatttctgtctccctttcttccttcctaccttcctgcttcctttccttcctttctatattatagctttccaacacaaattatgaaatcagcaccaataaataagttatagatgttgctaactggatccaaacgggttatccactatttataataagtaaaagtttaggtccttggagtttattataacaaataaagaagggaaattaatgcgacttggaaaaaaatagtaatagaatccagaaagctaagtttattaaagattcatttgcttatgaaaataattcaattaacaattattagccttaaacagattaagctaattttgagagttaaatatctaccacatatagatgaacatttttatgttgacaattttcattctatacaaagcaacacacaatttattattgaacaatgtcaaatttctaaactgcaatatcatataacacctttcacagaaaatgccataaaactaaattgcatcatttcttaagtaaagatagaggaagactaattgctttagaagggctatgaaggccaacatagataatataattggatttctaattaatttaatttgttttacaattaccatagataaattgctattaccacaattcttttttgttgttaaaaatttaaagtgatataatttatctctaataaatgagagataaagtaattgacttttataaaatacattactatctattccccctagagacatatataaaaacaagtgaagttttagatactgttgtacaaatctgcttgggttatgtagaattttagtgaactttcagggaattccagatgaagatcatagaatagtatccttattaggatagacaatactcatgctctttttctaattcagaaagttgatactaatatttataataatcattatggattgaggtaaatttgtttgggtgagagggtgtagcctcaacaggagtctgagcaatgattgtattggtcagaaatgagacctacaggatccctatgcaacactcaatcaattggcagagagagaacaattgctgttaggacatattagttacataactgacgactgctgaacactgtgattttaattcattaaaatcatttaagttccattaattttcttcagagttccacagcatttttaatggtaaacttatagcacttattatagggcttttaagattagatgttcaattttctagtttattataatagataaagatttggcttttctggatattttttgccttttggtcaaaaacgcagatgataaatgtgtcaaatagccatttttggtatcagttgtataaaggccaataatgagatacatcttacaaatgttctttaaaaaacacctctaaatcttacatattctctttgcaattagaaataacattcttatttttgtgtaactcttattacctaaagagagttaaagggtttatgaagaattaaaaagagtgaagaatgaaacattcattgtttcaacaaccctagacatttgaaaatatttcaggagcctaaagctgatgtaattactattagagatctataaaaagaaattacacctgtgtaaaaatctgaatgtcagtaaaatgcctctgagtgcttaaactatttcatttttcaatctacgaaacagagataatatttgccacccacatatctcagaggaatgacatgaagaaagtgttttgtgcttttgtcatatttagccttcattctaatcatcctattaacctgcttcttagtcattacaaagacatccctgacaaagcgacatgtcattgttaaaacacattcctttaactctcatactgtacatctttgctcccaggaagaatttgtgcccaaggatggtgcttgacatttgatttaaagggacttttatttaggtttctactatcaagtatttgagccattttaactattttacttacacatactctgaatcgggcacctaacaataaagcaaattttctttaagaacttaaatacttacagaagaaatttctgtaatgcatctattcagaacttttactttgagctaaaagataaacatcattcaacaaccatagttataatgcataagttatatatactaaatttactattcaggtgttacctaagaagaaatttaagtataataaagaacacttatttttttactcaactacactttatttcctaaaaattaatgtgtattgcaaattaatcttaactttaggtagaaaatggtttagtgctctttcagatgttgatgttaaagataattttgctttaatgcaagataatattactcatttttggtttggcagaaaatactacttgtctcaaaatatccaatttcttttcttctcatatatacaggcagactaaaattctcaagattcctatgcagtcgagttttaccatatgactgagttccaacaaagaaatatgagtagaagattgtataagcatcatttttgacccagggctttaagaagcaggtatgtccactgactattattttttcttttccactgcttatatatcaacacgtctgtaagagatgctaaaaccacagatagtcgactggctacttgaatcagactcaggctgggaaaactcatgttgaatggtaatgtgagtatgaaataaacttctattttgttttagacataatacacctttggtgctaattgtactgcagcttagtccactctaatataacagtgtaataattatttcttttttatttggactttaaaataattgaataatgaatgcaaacttagcattgatattcacttattaatattactgttacttaaataaacacaagacaatgattattactaatgacaatgtagcaaaatctgaatcataaagacagcaaacataaaggcatgcaagcttaaccatcaagttagcaatattcttataatgtgagcagcaggagcatatccatggttctccttattttataaacagaaatcaagtataaagtatgtggttgcttataagtctttgaagggaatgagattttatccagcttcttagaaataagcacatgagcactgacttgattctctgaagctctcatagatgataaaagataaatgtttctcattccaaaactctggaaatttgtattagatcacactccctcttttaattaatatgcaaacacattgcagcacgatgatatatgttttcacatgcaccatctcatttgatagtccataacaactcatatgacacatcagtgtaccctattttgaagaaatacacaatgaaaatcagataattgtatcaataaccttaattcacagcactggaaagcaacagaaaaaaagatttggtgggagatctccttgctttatgctgacaattctttctatattaatattttggctgtagcttggaattataaaccctctggaatagaagaattttgtttccagcatattaagtgtatctcttgaaaaaaacaaataagaaagctaaaatttattttaatgtttttaaacattagtccctggttttataattaataacacatctacaaagatttttattttttatttttaatcaagcaaaaatgggaatcctgggatagaaacaagtaccaaaatgagaatgtttcttgtgataatctacctagactgataacactgagattccattttgacagttgtacaaattgtgggaaataataattcctggagccagtctggaaagagaatagcaggctcccacatgaatctggggccttcaaagtgctactctttctgagaaaatgttagtgaaagaaaagttgaatttcccaaccctagtatatggtaggataaaaaaatctattgagaatttgtaaacataaatagttgtccacaaagttgtgtggcctgaattcattcacactgtttagttataaaacatcaagcagatagctttgtttgaagccatcttgggattgtattgcttctaggctactagcaaagaaaatacaaaccatttctggagaaatgtaagttttcttatataataacttaacagataaagtccaatgaatgtgaattcatagcaaagtaagaaaatgcaatcaattcttattatttgcagtagttatgctccataaagttgctgtgaacactggattagcaaatattgaacaattgctcctaagggaaatgtggggttaggttcctatgagcttgtggtcataatgttttcattaactgataaatacatcattttttattatgtatgtttctgtttaaagacaccttaattaatatatattgctagttcattaacattgaactcatagccgataagatgccttttctccagaaggcacactaaaattttcatttgtttagaagcactaaaaaacacttcagcactacgcttgtgggccattttaaaatgtaaaaaaccatataaatgtgaaaaatatggccctaaatagacagcaaaaaaggtcatttatttatagtaggagatctgaaacaagaggcagaacttcactctgtttgacctcagctgggaatctatcaggtgactcaaaatttttttgctacattgtgaatatacacgaatgaccacagaagtgccatgagtattgattttagggttacaaatatattttagcaagtagataaattcacaattacagaacccatgataaatgaagaccaagtatactgcctagccctgtatgcttgagctaataaaaaaataagcaaacagcagaatcagccatgtaaaaactttttgtgttagaattatctacaaaacatacaataaatacatttaatattctaaaagaaataagaatccttgaatgagcatagattaaggagctgtaaacatgaccaagcagatttcctaaagaaccattgtagaaatgagaaaatatgaagggttttttttctttcttttttattatactttaagttttagggtacatgtgcacaagatgcaggttagttacatatgtatacatgtgccatgctggtgtgctgcacccatcaactcatcatttaacattaggtatatctcctaatgctatccctccctcctccccccaccccacaacaggtcccggtgtgtgatgttccccttcctgtgtccatgtgttctcattgttcaattcccacctatgagtgagaacatgcagtgtttgtttgtttgtttgtttgtttgttttgcgatagtttgctgagaatgatggtttccagcttcatccatgtccctacaaaggacatgaactcatcttttttatggctgcatagtattccatggtgtatatgtgccacattttcttaatccagtctatcattgttggacatttgggttggttccaagtctttgctattgtgaatagtgccacaataaacatacgtgtgcatgtgtctttatagctgcatggcttataatcctttgggtatatactcagtaatgggattgctgggtcaaatcgtatttctagttcaagatccctgaggaatcgccacactgacttccacaatggttcaactagtttacagtcccaccaacagtgtaaaagtgtttctatttctccacgacctctccagcacctgttgtttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccacttttttgatggggctgtttgttttttcttgtagatttgtttgagttcattgtagattctggatgttagccctttgtcacatgagtagaatgcaaaaattttctcccattctgtaagttgcctgttcactctgatggtagtttttttgctgtgcagaagctctttagtttaattagatcccatttgtcaattttggcttttgttgccattgcttttggtgttttagacatgaagtccttgcccatgcctatgtcctgaatggtattgcttaggttttcttctagggtttttatggttttaggtctaacatttaagtctttaatccatcttgagttaatttttgtgtaaggtgtaaggaagggatccagtttcagctttctacatatggctagccagttttcccagcaccatttgttaaatagggaatcctttctgaactaaaggaggaagtttgaacccaaggcaaagaagttaaaaaccttgaaaataaattagacgaatggctaactagaataatcaatgcagagaagtccttaaaggacctgatggagctgaaaaccaaggcccaagaattacgtgacgaatgcacaagcctcagtagccgatgtgatcaactggaagaaagggtatcagtgatggaaggtgaaatgaatgaaatgaagcaagaagagaagtttagagaaaaaataataaaaagaaatgaacaaagcctccaagaaatatgggactatatgaaaagaccaaaactacgtctgtttggtgtacttgaaagtgacggggagaatggaaccaagttcgaaaacaccctgcaggatattatccaggagaacttccccaatctagcaaggcagggaaacattcagattcaggaaacacagagaatgccacaaagatactcctcaagaagagcaactccaagacacataattgtcagattcaccgaagttgaaatgaaggaaaaaatgctaagggcagccagagagaaaggtcaggttacctacaaaggaaagcccatcagactaacagctgatctcttggcagaaactctacaagccagaagagagtgggggccaatattcaacattcttaaagaaaagaattttcaacccagaatttcatatccagccaaactaagcttcgtaagtgaaggagaaataaaatcctttacagacaagcaaatgctgagacattttgtcaccaccaggcctgccctaaaagagctcctgaaggaagcatgaaacatggaaaggaacaaccagtaccagccactgcaaaaacatgccaaattgtgaagaccttcgaggctaggaagaaactgcatcaactaacgagcaaaataagcagctaacatcataatgacaggatcaaattcacacataacaatattacccttaaatgtaaatgggctaaatgctctaattaaaagacacggactggccaattggataaagagtcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacgaagaaggttttttaaaataaaagataaatcaaatggcagagtagtcaaaatttaaaaagagcattaacaaactgaaattgtggtctgaggaaattatccagggttagccagaaaaaaaaaaggaaaaatgtgagagagaggttaaaacacatagcttatagagtgagaaagattaacatttgtctactcaagtttaggataatggaaagagtggaacaaaaacaatatttgaggggataatggctgagatttttttccagggttgttgtaacacattaacctcaatcccagaaaacccaatgtattttcattatagtaaataaaaataaatctatacctagacgcatgacagtgaactgacagacatgaaagataaagagaacctacactgtatacatattatattgataattgatttctttttagcctaatagaataatatcttacatgtgttgaggaaagattactgtcaacattaaaatcatatgcccagtatatctcaaagaatatggacaaaattaagaccttttattaaagtacagaaacttctacttttgagtatctagtaagttacatactcattatcaacaattattaaaaataagcttaaggcagaagaaaaatgatctcagattgaacttataagatgcaaagggaaatagtaagcaataataatgataaacatattggtgagtctaaacaaactgattgcataagactacaataataacattttacataataatcatttaattatgtgtgagtaaaaaattaaaatacctgacaacaatgtcattaaatggaggaagggacagtcagttttcaaaatcctaatgtctttgtaattttataggcactctgtggaaaataaagatataaaatatctttatttagtattgagttaagtatacatggaaaattatctaaggtcaaccctgaataaatataatacagaggatgccttcaaaagtgcaattaaaaaaattcaagagaaggcaacaaagaaaaaataaaaacaaataaaaacaatgacataagcccaaagcccagaatagaatagtagaaatttgtgcagatatatcagttgcaatgatgggcctaagttctccagtgcaaaaggtatttttcagacagtttaaaaaggaaatctgccaatatactatttacattaggtacacttgaaatgtaaggacataaaaatagattttaaaataaaatttggtgtagctatattaattttagaggaagagaacttaaaaatctattactagataagcacgaaactcatttcatagggattatatatttaaacttgaattcatatctaacatgggttgaaaacatatgcaaaattaattataaatgggcaagtctgcctttattcacagagatgttaaaacactatattcagtaactgatagatcagactgacaaaagggtgataggtgtatgagtgttcattttataaccttttcctttactgaaagtcgaagtttaagaggatatttactaaaaaaacgtctctgaaatattgacatatgcagcacatttcattaaaaagctagctacaaacaatgaagatatagtgtctggttgaaactatgttcttctacttggaatactttatcttttcctcttcacctagctaaattatactcatctgagttctcggttgcctcagagaagcctttttgaactcttggacttggtttagtacccaagtacctgctttcattacaccctgtaatactccaataatgaaactcaatgaacttgttgttatttgtttaatgtattttaccctgataaatcaaaaacatgaagccagaagcacatcattctttttctctcttcagttctaacacaatgctaccctcaccatctagtgatagattcttaattgtatatgtaaaggagggaagaaaggaagaaaaggagggatgttattctctattagttttgttgcatgggaaccccagagaatatcctggcattactttgagacctatggggattccagtgtattggaagagtaggagtgttgctggaaatgaggatgcgtaatgctccttcaggaagccaacaccagagagaagaaatgatgcctgccatataatgacaggacttactcaagagccattatgggatgccacttacggacttctataaatcattgggttaagggaggccactttgcagggaccagagtccctgaaataaatacaattatataaaatagtaaaaaataagggttattattgtcccattcatccaaattcttaaactcaggctgatatggcgtaagcaaacatagactacaatataaaacacaacagtgacttataatactcagggcataaggtatgtgccatccagattaccaagatttttttttattcgtaacatgataagagcctttgtatatacagaaactaacttcagaattgactatgtcatgagtagttagaaagtaaggccacaaacaagcaaacaaacaaaaaactgctgaacttaataaaaacacagaaattacagaagacggggagcggcacatctgctccagaaggaattttcaatgaacagcaagaaaaagaaaaaagcttcaccctgaagatttttaagcctggcagagaataaacacaaccattacccaagttcacagctgtaaccttggggagctgaactggaacacagaacagttgccacctgcacagctgaagaaagactaatagcaggaacttaacatcagatcggtgatttcttggctgcagaaaatgtggcatctttcataaagcaagctgttttcctgcttttagtgactccaattctactgaagattgttgttttataatggagaaaaacccttgctggcaacattgcctatatactgatctgtcataaaagactctaacagatgtttgtgcccagtctcccctgtgacagaatattcattgtgggtaatgtttgcagcacattctgcccacgagaagataccagtgatgcatttctcccaaacaacaagcattttgtgcaaatatccagcacatctctgaagattgttaatccaccacctttcattaagtaaaattcacattcaacagtttacagaataagggagaaaatgggaaaataaattgtaaattccttttccttggcaagcaaccagattgcagtattgcaattagaattttccccaatattaatttgtttttttttgagaaaaccgatagttgtcttgtagaactttccatattctattctcaaaaaattatttcctcatgattcagttatgattatacatttttggcaagaaactattggtgaactgtcttttattgcattgtgtcatgagaaatgtgacatcaggttaccccactattgttgatgtcacctttaatcacttaaaatggtgagtgcgagatttacgtatctcttcattgtaaagatacatttttctttggaataagtaggtgagaggaaggtgccatgaaaggcacagtttaaacaattgaatatagtggttgagattgaggcagagagacaaattgggcaattgttatagtaatccatgcaagaaattatcagagactaaaagagtggtggcaaggtagaattgggtagagagaaagaattccagaaatgttaaagtggctgaatcaacaggaactgtagagtgactagatatacgagataaggcaagatttaaagaatgtggaaaggagtgtaagctaagtactaggtttggggttgcaagatgaaaatagcggatttctttttggatcttctgagtataagattctctgaggaatttcaaatgtaaatatcagttaggtatctgaaagtaaaggcgactaaaatttaagagaggttactgtacacactgtatatttgcttaatttccttttctatctttcctgatggattccatttcatgttgatgggtgataatatttgaataacaatgcataaaagtgatatagtctgtgtttgcagctcatgtttatatgtattcagaaagtttacattaaatgactatgaagagatctcaccaatttcctttgacaacccattgaaccagctctatttattataaaattcccattataacggaaatagactttcagtacctgacacttcttttaaacttttattttaagttcacggttacatggacaggtttgttacataggtaaacttgtgtcttgggggttagttgtacaagttattgtatcacccagttattaagcctagtacccatagttatttttcctcatcctctccctcctcccaatctccactctctgctgggccccagtgtgtgttattctcctcctttgtgtccatgtattctcattatttagctcccacatatgagaacatgcagtatttggtttttttttcctgtgatagtttgctaaggataatggcctccagctccatctacgttcctacaaagggcgtgatctcattctctttatggttgcatagtattccatggtgtatatataccacattttctttatacagtcgatcactaatgagtgtttaggttgattccatgcctttgctttcgtgaatagtgcagaaatgaacatatgcatttatattacctgacactttaaatgtttgcttgtgtttctaccacttcattgtcttcttagataaatctatgcatatatgtttatcacattttacacaaatagaagaatgtgctgtccttactgatatctgtattccaagaatcaacaacaaatggacattttatccattgtcttacatctcttattctgtggatgtttcacacagttaattctaacacaatgggaaaacttccaaaatatatgattcatttaatttaaacaaagcttggaaaacacaactgaggaaagaggtttgttttctgatgatagaggtagttcaaagaaggtgttaattattgtaaattttgggacttaaattgcaacctaatccattggttattgaaactcagaacttgagtactcagtaacttgaaatggaatagaggtccttatgtcttatttgtaaaattttcatctcaatcattttattctagtgtcccatggtttaatattcatcttatgtcagaattaagtgttctgtgatgttcaacaaatttgtaatctcactgaaggtataaatccggaattttactgtttctagaaacagtttaatcacactgtatatgttgaagaagtttggagtaacatattggccacttaacattatcttatttaatagtcattacaattttttgagataagcagtgtaatcctatatcaaagacaaataaattgagacttaggaggtctcaataatttacataattccatataaccaatcagtaaaaaacaaacaaaacaaaagaaaacaaacttggtaggtctgcctcactccaaacgctggactcttccagttctaccaattgtcttcagtatgctgtgccttaagaaatttacttaactgtatcaaatggtcctatgatatgtgcttggacacatatccaatagccaactctcctcagaaatctccaagacagtcctacttgcagggtaatgtcacattcagcccctcactaatagttagtctattcgtcttgtgctttatcattaatgttcctctgatttttacattctgcattaggctaagcatcaaaataatatgcacagttttttaaaaaaaaatagatgttcctttctcactcctaactattctatatcagtaagatatttttcttatactaaaacatatcacacttgttttaatgtaaggataatgtcttgaagtattcagtaataaaattacttaatttcccaaatttgagccatgttttcctaaatttgggcaatatttatgcttcaggaagatataccctgtttggttcattatttggattgtaacttcctctttgtagttttcatctgtgaaatctccagttgcagggactgtgcatacttctggtaatccccaatgtctggtgctaccgtgaagcctatgagcttccagtatcagatgagtcagaggtagattaagactgaaaggtagagggtcttaaaaccaatagactaagagcatggatttgatcatttatccccaagtttaagcaactatcttcagtagttggcttacgctagagtcaatggatataatgtataacatatttggagttatttattagtatttatacaaccctataagaagtaggaaagaatgaaaaggaaaagaagaccatatctatgaataatttattgatgatctgaacagaagttgacaaaaactccactgtcaggtgggaagaggtttgttaggaaattcagagaaatgcaggggcctagttaagatgcttgtgaaggtatacttttttttggcaaatacatgatttataaatgtcagtttcactctatattatcaagaacataattaatatttttatttttttaattttattattattatactttaagttttagggtacatgtgcacaatgtgcaggttagttacatatgtatacatgtgccatgctggtgtgctgcacccattaacttatcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacctgtggatgtgtctttatagcagcatgatttatagtcctttgggtatatacccagtaatgggatggctgggtcaaatggtatttctagttctagatccctgaggaatcaccacactgacttccacaatggttcaactagtttacagtcccaccaacagtgtaaaagtgttcctatttctccacatcctctccagcacctgttgtttcctgactctttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtagatttgtttgagtacattgtagattctggatattaggcctttgtcagatgagtaggttgtgaaaattttctcccattttgtaggttgcctgttcactctgatggtagtttcttttgctgtgcagaagctctttagtttaattagatcccatttgtcaattgtggctgttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgattttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcatttaatctatactttaccttgggcagtatggccattttcacgatattgattcttcctatccaatgagcacagaatgttcttccatttgtttgtatcctcttttatttcattgagcagtggtttgtagttctccttgaagaggtccttcacgtcccttgtaagttggattcctaggtattttattctctttcaagcaattgtgaatgggagttcactcatgatttggctcactgtttgtctgttattggtgtataagaatgcttgtgatttttgtacattgattttgtatcctgagactttgctgaagttgcttatcagcttaaggagatttggggctgagatgatggggttttctagatagacaatcatgtcatctgcaaacagggacaatttgacttcctcttttcctaattgaataccctttatttccttctcctgcctaattgccctggccagaacttccaacactatgttgaataggagtggtgagagagcatccctgtcttgtgccagttttcaaagggaatgcttccagtttttgcccattaagtatgatattggctgtgggtttgtcatagatagctcttattattttgagatatgtcccatcaatacctaatttattgagagtttttagcatgaaggagtgttgaattttgtcaaaggccttttctgcatctattgagataatcatgtggtttttgtctttggttctgtttaatatgctggattacatttattgatttgcgtatattgaaccagccttgcatcccagggatgaagcccaattgatcatggtggataagctttttgatgtactgctggatttggtttgccagtattttattgaggatttttgcatcaatgttcctcaaggatattgatctaaaattctctttttttgttgtgtctctgcccggctttggtatcagggtgatgctggcctcatgagttagggaggattccctctttttctattgattggaatagtttcagaaggaatggtaccagttcctccttgtatctctggtagaattcggctgtgaatccttctggtcctggactctttttggttggtaatctattgattattgccacaatttcagagcctgttattggtctcctcagagattcaacttcttcctggtttagttttgggagggtgtatgtgtcgaggaatttattctagtttatttgcatagaggtgtttgtagtattctctgatggtaatttgtatttctgtaggctcggtggtgatatcccctttatcattttttattgcgtctatttgattcttctctcttttcttctttattagtcttgctagcggtctatcaattttgttgatcctttcaaaaaaccagctcctgtattcattagttttttgaagggttttttttttttttttgtctctatttccctcggttctgctctgattttagttatttcttgccttctgctagcttttgaatatgtttgctcttgcttttctagttcttttaattgtgatgttagggtgtcaattctggatctttcctgctttctcttgtgggcatttagtgctataaatttccctctacacactgctttgaatgtgtcccagagattctggtatgttgtatctttgttctcgttggtttcaaagaacatctttatttctgccttcatttcgttatgtacccagtagtcattcaggagcaggttgttcagtttccatgtagttgagcggttttgtgtgagtttcttaatcctgagttctagtttgattgcactatggtctgagagacagtttgttataatatctgatcttttacatttgctgaggtagagctttacttccaagtatgtggtcaattttggaataggtgtggtgtggtgctgaaaaaaatgtatattctgttgatctggggtggagagttctgtagatatctattaggtccacttggtgcagagctgagttcaattcctgggtatccttgttaactttctgtctcgttgatctgtctaatgttgacagtgggtgttaaagtctcccattatgattgtgtggcagtctaagtctctttataggtcactcaggacttgctttatgaatctgggtgctcctgtattgggtgcatatgtatttaggatagttagctcttcttgttgaattgatccctttaccattatgtaatggccttctttgtctcttttcatctttgttgctttaaagtctgttgtatgagagactaggattgcaaccccttcctttttttgttttccatttgcttggtagatcttcctccatccttttattttgagcctatgtgtgtgtctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatggagtttcttcctagccttgatggtctttacaatttggcatgattttgcagtggctggtaccaattgttcctttccatgtttagtgcttccttcaggagctcttttagggcaggcctggtggtgacaaaatccctgagtatttgcttgtctgtaaaggattttatttctccttcgcttatgaagcttagtttggctggatatgaaattctgggttgaaaattcctttctttaagaatgttgtatattggcccccactctcttctggcttgtagcgtttctgccaagagatccgctgttagtgtgatgggcttccctttgtgggtaacctgacctttctctctggctgcccttaacgttttttccttcatttcaactttggtgaatctgaccaaattatgtgtcttggagttgctcttctcgaggagtatctttgtggtgttctctctatttcctgaatctgaatgttggcctgccttgctagattggggaagttctcctggatatcctgcagagtgttttccaacttggttccattctccccgtcactttcaggtacaccaatcagatgtagatttggtcttttcacatagtcccatatttcttggaggctttgttcgtttcttttattcttttttctctaaactccccttcttgcttcatttcattcattcattcatttcatcttccatcactgataccctttcttccagttgattgcatcggctcccgaggcttctgcatattaatattcattcaagtcacaccctgtatctctgtgtcttagttaagttagaaaagtaactttttcgtcacatgatccagaataatttcagtttatagatattagtagctaataaattgtattctcattgtaaaataataatatataaggggcatgcaggagaaaaagtaaaagaagaataaggaagccaaggtaagagtttgttaagtaaattctcatcattttggtttggaatgtaaatataaatgcttcaaaatctgacagctaccctcagctctatgattagtcgctctgttttcctgctaagtcagcagatgcttgtgtctcaaacatgaggttcctacttgtaagaaatgccagaaaagacagaacactaggtcatccattttccctagctaaacaaagctttcattttgcttgttcccagaatgaggcaaactgggaagaaactatggaataatggattggatttatgggcatacattagaggtctataaatcattataaatcacttgtctcttcataaagccaatatgttatatagaaatgagctatggacaagggttatatagggaaatctttcacattactcgcagtaagaaagtcaagcagttgatctttcacaatggcatgtaattctggctgaaagaaatgagggcctattttttgcctcaatattttcttgcaaaacagggatatattattccaatttgttgcagtaggcaaaattaaattggtaagagttatttcttggactctgtttctattttatctgctactgaatcatttaattcattattttatacttaatcagattttagctcctagattattgggctttaaacttttaagagttcttattttttctccttattaaaaaccttggcatgttaccagcacactacataaaagagggccatagcagcgctctccctggaaaattttatttgaagcaagtggtaggcataataaaatgttcccacaagcttagaaaagtttaaacaatacacagaacaagtttattgtgagtttgcttcctgggttcaagttatggtaccctccaactataggcattctctccacctttacatcattcataaatttcatgagaaaaatgatacttcagtgactattgctcagttaccatacaaatagagaagatagatgttttttcttcccatctgccattatggaattagttaatgaatgctgtaacaccatagcatttagcaaatttgaaggatcttttttttcatgtttactacagttccttgttttattctccaggtagaatctactcagttacaactcttaatcttattcaatattgacaaccagatttctggctggctgttatactcaatgatgctgcccctcccatttttattacaatggaaagcctgtagctaggtgatagaggcggttgcctgtgaaatgtaacccaatacagtacattttagtttgttagatgttctgctttggtcttctgacagttgttctggaagtaaataacatctgccatacaattggctggcaaaactcatttgtagtataattaaacagccatcattttgttagagcataaacacaaagataaatagtccatgaattagcaagtgcaacatcatttgacagctcacagctagacaggcataatatagattttacctatatgcagagtgtccttgcaagacagctaacaaaatcaaaagcaaaatcagtatctagaattttcaaactggaggtgggagtgtttggacagccttagcaatcttacttttgccatattttgggccttttctttgatcttgcatggtggccggtccaggtggtcttcttcacctttaagttatattttaaaggttttccatctttggcattttcttttctagaattgtcaccaccatttcttcattagagctagaacagaaaccagaagtcaacccaacttaagtattagccataggtatttatcttcctcccaggtgtctggtaaagtagtttaatttatgtaaaaaggtcagaaatgaagaaaaaacttgtagaaatttatactttatttttgtgctctctccaaaatggctgagaggattgcctctgaataacaggtaatttaatgaagcatttcaattcacagtcaattctgttttataaagaactgattgtacagtggagtagtgctatcctttgctgctgtcccttcctcccttggctctttgcctttggactggtttgctggacattaggagtgttgcttttagaagggcaaaggaataaaatggatacaatcttcagagtatggttaggaaggaccagtgaagccagttgtcagtgaattttgtatccatattgtctctatacatgattactgagctcctttaaatgtagatacacgaatctttatatcactctttcttaaatgagaagaggaactattttattcttagaatagaatatagtcagtagtcaataaaatatatgttgaataaagtaataaataagttaaataatttatttcaatttgcttgaaataccactactgcattgaagatgagacctatgaaatttaatgactgttagcaattaaaactattttatttccattgttatgctttccatcttgtgtatagctactgttgataattactgagtgagctcctctgctgaatgcattatataaatactccattaatttctgcaaacatttattgttttaattttatgataaaaatgttatattctcaatttccatgattagtattgatcagattgagctgctctatgctgcagtaaccaataaccttaaagattcagtggcttcataaaattaagtttattttctgtttatgatcaacttatattgtaagacattagagggtttggtccacatagactttgggaaagtgagctgagaatgacaacaccaccttggcactatatcatctggagcatgaaaaccccataaccacagtttgcaggggaggagtgagtgagctggagtgtcatgcaccagctcttttatgctttggcttcaaaatggtccaggtgacttccactcacagcccattgaccaaaaacctgccaaacagccctgactaatttcaggggtggggaaggtggtgagggaacagatggaatctgatgagcaccactgcccctgataagcaaagttatgtgccctctggaaccagattagaaaacacagttgacattgcttaacaaaaattgaaattcgaaatccagaaattcacattacagtagaacttgaaacacattgaaagacactacagaagaaaaattaacatacattatcacaaagtagaatttatcaagagcaggaagattgagtcaacatttgaaactgatcaatataatccaccaaagaatagaataacacagaacaatcatatggccataataataaatctataaaaagcttttgataaaatgttaacagtaccttcatgattaaaaattgtttgttagcaaacaaccccatcaaaaagtaggcgaaggatatgaacagacacctctcaaaagaagacatttatgtggccaaaaaacatatagaaaaaaagctcatcagcagtggtcattagagaaacgcaaatcaaaaccacagtgagataccatttctcaccagttagaatggtgatcattaaaaagtcaggaaacaacagatgtggagaggatgtggagaaataggaatgcttttacactgttggtgggagtgtaaattagttcagccattgtggaagacagtgtgacaattcctcaaggatctagaagcagaaataccatttgacccagcaatcccgttactgagtatatacccaaaggattataaatcattctactataaaggcacatgcacacgtatgcgtgccacaataatgtggccctgttcacaatagcaaagacttggaaccaacccaaatgcccatcaatgacagactgaataaagaaaatgtggcgcatgtacaccatggaatactatgtagccataagaaggttgagttcatgtccttttcagggacatggatacagctggaaaccatcattctcagaaaactaacacaggaacagaaatccaaacaccacatgttctcactcataagtgggagttgaacaatgggaacacaaggacacagggaggggaacatcacacaccagggcctgtcaggggttggggggctaggggagggatagcattaagagaaatacctaatgtagagaacgggttgatgggtgcagcaaaccaccatggcacgtgtataccaatgtaaaaaacctgcacgttctgcacatgtatcccagaacttagagtataagaaactttttttttaattgttagcaaactaaaactagaaggcaacttcctcaatttgatgaagggcatctacaaaaataaatagctgatgtcacatttaatattgaaatattaaattctttaacccaagattggaaaaaagataaattgccctcttttactacttacatttaacactgtgctataataagggtcatgctcagcagatgaaggcaataaaaaattacaaaagaaatacaatttggaaaataaaggcaaaaatgtttccatttacagacaatatgattatgtgaaaaattctagatgctaaaaactcctaaaacataaatttggtaaggtcccaagatacaaaatcaatgtacaaaagccatttgcattcctgcatactagcaaaaaatagttggaacataaaatcttaaaaatatgccatcaagaacataaaatactgtacttagtcataaaatttaaaatatctacaaaatctatacaatgaacactacaaaaaattgttaagtgcaattaaagatctaacaatgagatataccaaggtcataaattagaagacttgattttgtgaagatttgtctatcattgaatttacctgcagactcaaggcaatttgacttgaaatcctaacattattttgaaaattgtttctaaaatgtatagaaattaaaaaaacctagaatagccaaaacagacttgaataacagaacaaagttgcattactttaactgcctaaattttaagtctaaagtaacaatacatgatatgcttatgaatagacaaatagatcaatagaacagaacagagattctgtacagaggcaagaaaccaaggtaattcaatggaggaaggagaacagtttcaataactggcgttggaataactggtatccaaatataaaggccaaaaccttatttctaaaacaaaacctaagaatactttcatgaatttggagtaggtaaagacattttagaaagaatacaaaaaatatcatagaaaagtgataatatggattccactcaaaataaacacttccattcatcaaacattttgttaaaacaatgaaaaggcaagacacaagtttgaagaaatatttgcaatgtgtattttgaaggatttgtaatcaatatatgaaatttacttttctgtatcaatgataatcccaaatgaatttacaagaaattttgtggccgggcgcggtggctcacacctgtaatcccagcactttgggaggccgaggcgggcggatcacgaggtcaggagatcgagaccatcctggctaacacggtgaaaccctgtctctactaaaaatacaaaaaattagccaggcgtggtagcgggcacctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaagaaaaagaaattttgtaaaggaaggtatacaaatcccagtaagttcataaataagaaaatgcaattattccccactacaagatactttattccccactacaagatactttctcacaccaactacagtgtctcaaattcaaaagactgacaaccataaattatgatgatggtgtataacaacggggaccatactataatggtggtggtaatataaaatagaccaaccactctggacaattctttatccgtttctcaagataaacatacatgtagactgtgagccagaaatttcacattttgacatttatctgggaaaaaaggaatacatatggtgcacaaaaagaattgtacaaaaatgtttatcacaacttgtatcaatagtccattagttattgctgagtagattttctccttaatgaacttttgattgttgaattgcaaaaatattattttgagtgaatgaagccagacagaatagagtacactccctatgattccattcatgtgaagttcaaaagaaagtaaaacatatatattgattgaaatcagtacagtggttgcctgtctgtcatattttgactgggattaactatcagagtgaatacattctttaaagcttattgaattgaactcttaagatctatgtgtttcagtgtatataaattttacctgaataaagagactaacacaggaaatgtttataactatacctatataggtatacatatctcaaatactgtttgagtttatttttctttttcttttaagcaaaatgtaatagagtaaatagttcgctggcaaacagaaaaacaaaagcagcaaacaaacaaaacccaaaaacctctctggatattttgtgagattaatgacaagaacaataaactattaaaacaacaataacacatgacatgaaggttaaaagtaatattacatcacaatctactggtgcagctgtcaacatgagaaccatttcttacgtatagaatcatttgtgtatatatttctgaaacacttcgtgagaaattgaatgattaagattttagaactggtgagaggaaaaaaagctatggcctaaaagctatatataatttctggtttagggcttcaattaaaacaaaacaaaacaaaacaaaaacatgtggagtgctattcctcaacatggctgtagaaaaatttaactcaagcaagtgcagtgagtgagatcaggcaaaactgcagtaaatacacactcaccataactataacttagtccaaaaggaatgaacaatcttctatacaaggtaaatgaggtgaaatgagaaagttgatgacctgtgttttatcatatatatatgatatatatatatatcattcatatatatatatgaatgataaataatgcattcattatatcatctacattaaatgtgctttagaaacaaatatatataggataaataatgcattcattatatcatctacattacatatgctttagaaacaaaaatttacttgatattttgacaaacccacccttcattccttaggttaatttctgtgttaatttttacattgctaatcattgtactgctgtagctaaatcatctgaatatcagtttatgcagtgttgctcaaaagatgtataaatagccagctctatgattacctaaaaacaagctttttaaaataaaggaagaaagcaacaatgttccaaatgaatggcacagggcaaaacacatatatcaaaacatatttagacagtattcggtgcccatcagtttctcttataaagataaatgcttgaggaagatcttgagagaaccctccctccctctaaatgtttagctcctacatggtgtcagatgttacaattgatatgaaggataaatgctttcaggcaaaagtaaaaatctatctacaaagcaatatagcaaaatctgtagtgacttttgtagaaagctcccttctctgatggtaatattctttagtatatatccaggatagattaaattgaaacaatatttctgatacaatagcaatactttcatatactgttactaaatattacaaaattccaaaaaatacataaatatcccttgtaccatgcattatgcaccagtttggggctgcctgataaagtcatggctagtattttaacaattaaacattacaactcaaaaattctgccatctatacacagtgaatggacacaatggtgagggctcctgagagatggcaagctacctctaaagtgaaaagtctgtggtggagtgtctccaaattaaagagaggggaacataactttcaacagtgaagtcaaaacagatgtaaataagattgaggaatttcttgaagaagtcttaagccctcccacgtacttaaagccttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacgttaagttttctaaacgtaaatttctggacagcaatgaaatgacattagctgattgcaatctgctgtcaaagctgcatattgtcaaggttgtggccaaaaaaatcgcaactttgatattccaaaagaaatgactgtcatctggagatacctaactaactaatgcatacagtagggatgagttcaccagtacctgtcccagtgatgaggaggttgaaatagcatatagtgatgtagccaaaagactcaccaagtaaaatcgcgtttctgaaagagatgtgttcatgtcttgctctaagaatttgcttttcctaacaggctactcctcttcctgtagagtagaaattgtattttgcatgaacatgcaattattgaagattaggatcaagcatagacaaggtatagtagttatcttaagatatacactcctaagcagtattattttaaaatcattttatccctctaaatgttcgaggaaggcatgtctattgtgattttaatgaagacagaattatttttctctgtagaaagacaaatactactttatcagggaagttagtcaaatgaaatggaaattggtaaatggtcaaaagctagctaggaaaaagatccaacaacatgctttaaccccattgcatgtttgtggaaagaccatagcttaaaatcttgagaaatttgggacataaaagttttcatggtagacagttcatggagtatatgaactgacattatggaaaaatctgattttatttttacagttaacaaatccattcctcttaatttaaacacctgttgtgttttacttcgatgaagagattggagtctgaatagaaagtctgttttccgggggatactgagaaatttttgtattcaggagttggaaagctctcttccattctagttgataaaacttccctttttttgatgtagatgcagattttctatacagttctgttgtcttcttttactaggactgttaacttttgtgataaaattcaaataagattttatttcttgataattttggttttcacaatttatctttaaatccttgagcaatctgtatacaattaagagatttctcacatttattcttaaactgagtagatcaactctaggatttaggcatgttaactttacttctgttgtgttttgaatctctccagagttgcatgtaggtagcttttatttctgtgcgcttacagtcaattagaaaatatctacaaagtaggctgggtgtggtggctcatgcctgtaattccaacactttgggaggctgaggcaggcagatcacgaggtcaggagatcgagaccatcttggccaatatggtgaaaccctgtctgtactaaaaagacaaaaattagctgggcgtggtggcgtgcacctgtagtcccagctactcaggaggctgaggcaggagaatcacttgaacctgggaggcagaggctgcagtgagacaagatcatgccatggcactacagcctgggtgagagagtgagaccctgtctcaaaaaaaaaaaaaaaaaaaaaaaaagaaaatatccggaaagtgaaaatggagaggaaatagaaatgtatttttaatgaacattttgatacaaatttcatcatttaatgattcaccaatttcttacattaatttgaattaagcattgaattcaaagagacaggagcattcattgatatatatggacttttaaaaattccatcctttataaatagacaaggtttgggctacaaaaattatatttttatcatggaaaaatttcaactcctcaagtcataatgttgaatagaattggagtattttctttagaatttcttgaacaggcaaattaaagcttattatagaatgcaagtatttacttttctctttggaatatcaaaaccagtgtattgctgacagctattgtattttaaaaaaatgtatattttcactatcataaaggattctttttcctccctcatgaaaataaatgacaactgggggtaaatatatatatatataatttctgaagtaaaaagaaagatcctcccttccaaacaaatatgatcatattttattctacttgtgataaaggcagtgaggcatttgttttggggaatgtccaaaatatctatgattttacttttccagccaaaacaattttgcttctctggcacgtattaatcaataggcaaaacattttgaacttttaaatattattccacatcacactaatttattctagttcagaaaaatttggagtgccagtatttctagcacaatcatatttttaatgggtgaacataaagtatttttcataagaacataagatagcagaaaatatatatttgttgaagaaatagaaataaataatataaagttgccaacaaacagaaaaccaaatgacataagtactaggaacttctgactagtatagaagtaatttaatatttatatttggacatacactggctagactaattattgataaagtagtcattgcccatctgcaaaatcaaacaaccataaagtaacattttgaattgtctgccatggggctcaaagtcttttatgtatcaacctttgatttaacacattagagtattaccatagtataatgaaaaatctaaaagcttttgaatcagataactttataacacagtacgtttgtcttttggtgtctgtgtcatcttgaaatttatatatatttctgaatcttagttttctcatgtttataacaactggggataataaatttacctcatttcaaaacatttacctttagtataaaaataaaaataaattatcaatataaaaataccatgcttgatacttaggctctaaaatattagacaaatttcctggcatcatagcgcttacaagtagttgagataaaggtggagaacaaacacaggaactaactcattagctagctcttaccttgaaaattaagtgcagaactctgggagaatgatgcattcaacaaacaatttttgaaattgcgaaaaaggagaatgggcagaattaaaatgctcagtagagacagtcaggaagggcaggccagggtaccagttcattgcagtaagtggttgttaaacacggaggtaatacacagcaacagaaaatagtaaaatgggccaaaactagaagagtagaggttgaggcaagaaaaactagacttcttttacaattttgcctagggttgacaatgtactttgggtttcaaaacaaataatttctgtctatactactatacagatgtaaatgaaatacatgtttactaagccagtggtatagattgttcagcattgacctagtttataattttgaaactagataaggtttttataaacatgcaaaaactgagtgctacttagttctgctttctggctttttgataatccaaggaagcagactcattaagattgaagtatccaggaagatatattttccaaaggataaaacctacttagatggagagtagattttaggctatcacttaatttcttcctgttaatttttggctgataattttattttaaagagtaaattttactacttaaattatttgtactctacacaaagatggaccataaaacacaatgcctcatttaggcagacttcgccataccagcagcattgtaactcaatccatccatttgtaaagctgtaaccactgctgacagaatgcagggtgggagagaggaagaaaattaaagagtattcagatggtagaataatactaacataagtagttacagtaattacaaatcattcaaccaaccactaatgctattagatggcatgatttattgaatatttacatatgtcgaacattgtgctcagttcttcatatttatgccacacaattttcaccatatttctgtaagataagcatcatttccattttgccccttctgcagttaatgctcagatagcataaacaaaatacccaaatctacacatatggagtttgaattcagttttttctaactccaagttgaatattcaaaagcatcctttgattttataatttaagatttctcctttttcaaacaccatttggtgagatagaaagcattagagataaaacacatatattaatctatgtggtggctctttcttctgcttaaagccattctctataatcctcataaagatctaacacccccactccagtatttcctatgtttctttagttctccattatttcctatttgtgcagtatcccacatgctcagggtgttataaaaggctgcaaattaatgaacatgtgctgcctttgttcggggattttatattataaatttgtttttatttattctacacatggttggttgtagtttgtcctccaaaatgaaatgaaattggtattattacagaaagatgactgagtcatattatgatagagactaatttctctgacctagtagactaaaagttttctgtagtctcttaatgagactccttttatagcatttgtatctttgtgcttaattattcttagtataaatatttagaaattgatgcatcgttttacttctatggcatgtcataaagctattttttcaaaaaaattgttttgtgtataatgtcatgcgaaaaagaattcttaaaatgatttaaaagatttagacccccctccgaaaatatcaacaaaatgaattttctaagataataagaaaatgaataaaatccccccgtagcagcaaataattgggcaaggaataaaatccgggtttggaggcagagctgaggaatacagcatgacttggttcacagagcttaccctctcccttgaagttgaattgatgagaacaaaatcttgagccttctcagaaatattccaaaactgcaaggaagggaacagaatttatttttctaatttatctctaaccttgtttcactaaagagtgatggaaatcgttactgtggagaaatgtgtgaaacatggcaagaaaataggaagagaagtaagtatcctgtgtcctcctgttccaggagaaaagccaaaccaatatttatccacctcctcctatcatcggaataggataagagccctctccttccccagtggaatgagtactggggtatttaacagtacctcagaattgatggtacatctcacgtgcagcacaaaacctttttaactctcagataaacatccacctgcctcatgccctcaagctaggggaaaaggaatggaaagcagccatatttgtcttcaaactgaagttaaaaaaacaaaatccaaagcagtcatcagatgtagtagaaagtcaagagtgtacttacactaaatcaggaaatatagcttctcaagcatgagaaagatgaatgaaaatggcatagtccatatagaaatgttctattaattataacaagaacattgataaagtaaaagaaaataaataaaaagaaattagggacataccattatacgacaaaaaaaaaaaaaaaaaaaaaaaacgagtccagtctagaagaaaatataacttaggcaaaaggaaaactcattttgtgtacattaaaagtatcattcaagaaaacttattcccaggaaaaaaatgatttgaggtaaatataaacatataattcaattatagaggattgattgcctaaagaaacaaattttaggaaaaattattattaaggaacttaacatcaagaaactataagttgaattatttaggaaggagttttgagataagcctacctagtgcatattttaaaaacatgaacctaaaagaatgctaattgaagatatatttcagtattccatactttgtgtccctggatcagcaatttaccaatagaaggaaaattatagtgggtaaaaatgttaaataagataataagtaacccctgaaatatttaattactagattttaaaataaaaaatccaaccatgatccagaaagatttgagagtgcgtcttgcaaatcaaaacgttttctctttccattattgaatcttgaagaaatgtttttaagaagaattattattcagatactcaggaagaaaggtgaactaaggtagggtgagaggtattagaagtctagtcttttaccttctatttctctacagcaatattttagacaatgggttaacatctacagattttaaaaagaaaagcatgacccactctttacagccagtcgagatgtcatctgcatattcgtctcactcactatctgtatatgcacatacacacacacacacacacacacaactccaagaaaacatcaatgattttttttcaactttctgggtttgtgatttgaggctgtttttatttacttccttccttctatttgcctgtctcatttacatttcttatctgtctaccttcattattaagaacacttaattctttgataaaaacaaatgaagtgacttttttttcctcttaaacaaaaatcttcagtttgatggtaaacgatttcactatactttaatatagggtcctcttatagcatgttttgttaataaaacaaatctatttaaatgtatgtaacatgtcaactatattcttttaaggtagatggcatttattagtcctctttgtgtttacttacaatgcctggcacatagatgtacttgatatattattttttagtaaataaatacatgagtgaatgaatgaatgaaatgataacaaacaagcaacaatatatactttcccttctactttggtctatgatataggttttgacaatacacaaactttaaattaaaacaaataatacagttttgaatttttaaaactaacaccagcctttaagaaattgttcatcacaaaattttcttcatattcttgggtatacccattcaaatatggaggttgagacactatcattttcatttgtccaaagatatttggccacagttttttatataactgcccttctgataacaggttaatgaattaggcctatcttttatgtgtttatcatacaatataatataactttattttggctaatactaatttattggttgtcgtttttctcaggctttcatgtattctaacttgcacaatttgtggtcttgcaaaagttagctgtacatgcacattctcctctaatcagcacaaaatcatcatgtgtcttttctagcacttgcactaaagaaaaaaggcctcttttgactacaatagagacaataggaaggctcaaaggttgaagacaaaagattctgcagaaattaaaggaaaagctgctagagagcatgacagctctttttgttattttctgggctgtaatttttgaaatcagttttcattttgaaagttccttaattttctcccacttcagtctaaaatatagcacacatgagtactgaagacagacagcccctcaaaatggttcaatcaggtggtatttgtaatgaagctgcaggctgttgcttggatttcttagtatcagtcttcataatcttctatatttagcggcagaaaacttgtaacagtttcttaagctcagttcactaaaatgaatgcaacaaattgtttttggaattagatattctctaggattcctagttataaatgacttgcttatagcaaatttccaatcctctatgcttcagttcctatatagctctctggatagataactctctttgcaggttcaagtgtcctttgaaagggatagaaaccatcatcgtttatttttgatattaaaacaaatgcttttaaactttttgtattattaaatgtgggactagctccaagggaaaagaagagaggaaaaggaaagaggagaggacaggagagaaagattatgttaagggaattatctatctgtaatttacgaagcctagttgacagtacttattgtcaactgtaatatacagtttccttcatcattatattaactactatattaatatattttatgcgagcagactgctgttgtaaatctttatcaatatcagtaaaaaattattttgaaatattgattttaactcacttccatttgatgatgtatatattttaagtacaattatcctgtagttttatttcaaggggttctttgttagattttgtgttctgtcattatgagttacattgtgtagcttgacaccattttttatattctgaatcagtgtgtctggcctgggaattaaatgtttcttaaatttaagaaaattcacaagtaaaagagcctccaccaatgtatctttaggaatttttaaaaataatatttcccaatttcttccatgagattatcaggttttattcttgagtcacttcagacttcttcaattttatcatttagtctttatttttgaataatatctagtttcctccaaaacagaccacttcatttataatatcaaatgtgtttttagagagttgttctttattacctaatatttttccgatttgttctctatcagttttaacaacatactgttagtcccaattttagcttatttgattatgagagatttgaattattttaagcactgatataactattaatgttctataagtaccagagatacatattaaaagaggcttagaaacaaggtattgtctcaagaggtggaaagtcaagggtcacatcaaagatatagcctgctttaagaacctctttccatctcttccatctgccatcattattcacttgtcttctccaaatcaaaagaaggctgctttttctttgaaaataatttctgaagaaaggggaagtagaaaaagtaaaagtactgtatctcactggtcagcttgtggcttgtctattcatacccattagtttttaaattttattttgagaaaaaaaaatctgaaatttataaaaaggttgcaaaaccactacaaataatttttcttaagtgtaaatttctaacctaatttcacataacttcctagtaatgtagtgtacattttctacaagtaagtcttcctcctacaaaatccagtatcacaaacaacatcatgaagttaacactgaactattaataacatctaatcctcgggtctccttcaggtttcagcaattatcttgctttttcttgtttttgaggactgaagaggtggtctcttgctgatatgtgaatggattcagttgctgttagtttgcttaaaattctcatgttaaattaggtaggcctataattttctggtcttctgagagcctgtggtttttatattattgtaatgcttacaaagtgtattttaaggtgttttctactagaagatattatatagcattggtataatttattatgaaagtattttgaaaaacacaaactggttcaggtttatggtttcttggtgggtaaatatttctattcaagtatattaaagtttctaatttatgaagtctaaatatcaaagtgtctcatttatatatctattggtttttatcagttacattgttttagataatttttcatttcatattcattttcaaatttgctttaaattgttcatacactttgcttaatatatttgtttgcagtgtctttgttgatagccttggcatctgacatttttcttgttcaatctttataaaattgtttattatatcagtcttttaaagaacttcctttttgatcttttctctagcactttgctctattttgattaatttatgttcctgttacatatttgcctatttctatttttctgagttactgtacctttctcagtaaatagcaactgtcctctgttaaatgctcaaactcaaaacttgaagtcatattttgattctctcaaaactcacatctaatccagcagaaatcctgtcagctttgtgttcaaaatattatggatgggataacttttacttctatgaatgatgggattttgaaagtcagtcctccatggggaataactaaaaacaaccctgataaatgaccaaagatataaatatttaaaagcatcagtgacttgaactctattttgttgaaaataataaaactacacctcttttctttggtttagatttgtaggaatatttttccatcccttcactttcagcctatgtatattcttaaagttaaagtgagtctcttgtaagcaggatatacttaggtctttttttttttctaatccacttagactctctaagatccatttatgtttaaagtaattattgatatgtaaggacttactagcgtcattttgctaattgttttcggactcatttgtatttcccttttcctttctttgactcaggttattttccattatgatttgatgatcttcagtggtgtgtttcagtttctttctctatatttatttactttgtgtgtgtgtgtatctactataggtttttactttgtggttactaagaggtgtacaacaccttgcagttataccagtctattttaagctgtaaataagttaagtttaattgcatacaaaaacttgacatttttgcttcttcttccaccttcaaatgttatgcttttaatatcacaatatatatcttttattgtgtatttattaataaaatattgtagcgaatgttatttttagcacttctgtcttttaaactttatattgaagttaaaaatgatttataaaccaactttacagtattagagtattctgaattgacctatatatttgcctttgccaggatattttaacttttacatattttaatgttagtaattaggctatctacatattcaatgaatctccatcaaaattccaatcacatttttcacatgaatagaaaaagcaatcctaaaattcatatagaaccacaaacaacctcaaatagccaaagcaaaattagaagagacatacaaagctggagacttcatactatctggttttaaagtatattataaagctagtcatcaaaagagtatagtactggcataaatacagacacatagaccaaggaaacataacagaaatcccagaatagaataaattcacacaattgtggtcaactaatcttcaacaagtcaccaagaatacataataagcaaagaatggtctgttttaaaaatggcggtggaagcgtgatgcgtacaactttgttcttttggctcaggattgtcttggcaatgcgggtccttttttggttccatatgaactttaaagtagttttttccaattctgtgaagaaagtcattggtagcttaatggggatggcattgaatctataaattaccttgggccattagtgtggccattttcatgatattgattctttctatccatgagcatggaatgttcttccatttgtttgtgtcctcttatatttcgttgagcactggtttgtagttctccttgaagaggtcattcacatcccttgtaagttggattcctaggtattttattctctttgaagcaactgtgaatgggagttcactcatgatttggctctctgtttgtctgttattggcatataagaattcttgtgatttttgcacattgattttgtatcctgagactttgctgaagttgcttatcagcttaaggagattttgggctgagaccatggggttttctaaatatacaatcatgtcatctgcaaacagggacaatttgacttcctctttttctaactgaataccctttatttctttctcctgcctgattgccctgaccagaacttccaacactatgttgaataggagtggtgagagagagcatccctgtctcgtgccagttttcagagggaatgcttccagtttttgcccattcagtatgatattggctgtgggtttgtcataaacagctcttattattttgagatacatcccatcaatacctagtttattgagagtttttagcatgaagagttgttgaattttgtcaaaggccttttctgcatctattgacatactcgtgtagtttttgtctttggttctgtttatatgctggattacgtttattgatttgtgtatgtcgaaccagccttgcatcagggatgaagcccacttgatcatggtggataagctttttgatgcgctgctggattcggtatgccagtattttattgaggatttttgcatcaatgttcatcaaggatattggtctaaaattctctttttttgttgtgtctctgcccggctttggtatgaggatgatgctggcctcataaaatgggttagggaggattccctctttttctattgattggaatagtttcagaaggaatggtaccagctcctccttgtacctctggtagaattcggctgtgaatccgtccggtcctggactttttttggttggtaggctattaattattgcctcaatttcagagcctgttattggtctatacagggattcaacttcttcctggtttagtcttgggagggtgtatgtgtccaggaatttatccatttcttctagattttctagtttatttgcgtagaggtgtttatagtattctctgacggcagtttgtatttctgtgggatcggtcgtgatattccctatatcattttttattgtgtctatttgggtcttctctcttttcttctttattagtcttgctagcagtctatcagttttgttgatcttttaaaaaaaccagctcctggattcattgattttttgaagagtttttcttgtctccatctccttcagttctgctctgatcttagttatttcttgccttctgctagcttttgaatgtgtttgctcttgcttctctagttcttttaattgtgatattagggtgtcaattttagatctttcctgctttctcttgtgggcatttaatgctataaatttccctctacacactgctttaaatgtgtcccagagattctggtatgttgtgtcttttttctcattggtttcaaagaacacctttatttctgccttcatttcattatgtacccagtagtcattcagaagcaggttgtacctgacttcaaactatactacaaggctatagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctggggaaactggctagccatatgtagaaagctgaaactggatcccttccttacaccttatacaaaaattaactcaagatggattaaatatttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagcaactaccatcagagtgaacaggcaacctacagaatgggagaaattttttgcaatatacccatctgacaaagggctaatatccagaatctacaaagaactcaaacaaatttacaagaaaaaaacaaacaaccccatcaaaaagtgggcaaaggatatgaacagacacgtctcaaaagaagacatttatgcagccaccagacacctgaaaaaatgctcatcatcactggccatcagagaaatgcaaatcaaaaccacaacgagataccatctcacaccagttagaatggcgatcattaaaaagtcaggaaacaacaggtgctggagaggatgtggagaaataggaacacttttacactgttggtgggactgtaaactagttcaaccattgtgcaagacagtgtggtgattcctcaaggatctagaactagaaataccatttgacccagccatcccattactgggtatgtacccaaaggattataaatcatgctgctataaagacacatgcacatgtatgtttattgcggcactattcacaatagcaaagacttggaaccaacccaaatgtccatcaccgatagactggattaagaaaatgtggcacatatacaccatggaatactatgcagccataggaaatgatgagttcatgtcctttgtagggacatggatgaagctggaaaccatcattctcagcaaaccatagcaaggacaataaaccaaacaccacatgttctcactcataggtgggaattgaacaataagaacacttggacacaggaaggggaacatcacacaccggggcctgtcatggggtggggggagggaggagggatagcattaggagataaacctaatgtaaatgacgagttaatgggtgcagcacaccagcatggcacatgtatacatacgtaacaaacctgcacgttgtgcacatgtaccctaggacttaaaataaaaaaatacaaaaaaatacaaaaaataaaaatggtggtagaaaaactatattcttgtgcaaaataatgaaattgtacccttaatttaaaccatacaaaaaattagtacaaaagagactaactggtgtgagatggtatctcattgtggttttgatttgcatttctctgatggccagtgatgatgaacattttttcatgtgtctattggctgcataaatgtcttcttttgagaagtatctgttcatatcctttgcccatagaactggaaaggtaaaaaacaaactagaagaaaacaggggaaaagctccttaacattggtattggtaacatttttttaaaatataacaccaaaagcacaggcagcaaaaacaaaaataaagtggaattgtatcaaagtaaaaagtttttttttttcttcttttttgtgatggagtctgactctgtcacccaggctgaagtgcagtggcacaatctcagctcactgcaacctcctccttccagggtcaagtgattctcatatctcagcctcctgggtagctgggattacaggtgcatgccacaacgcctggctaatttttgtatttttagtacagacagggtttcaccatgttggccagtttggccttgaactcctggcctcaggtgatctatccgcctcagcctcccaaagtgctgggattacaggcatgaaccactgcatctggcccaaactaaaatgttggtacaaagtaaaggaaatgatcaactaaatgaaaaagtaacctatggaaagggaaaaatatttgcaaactatatatctggtaggggaatagtgcccaaaatatatagtgaatttatgcaaattaatagtaaaaagcaagtaaccaaatttaaaaaatacacaaaatacccgattagacatttttttccaaagaagacacacaaatggccaagaggtacatgaaaaagtgctcaacatcactaatcatcagggaaatgcaaatcaaaaccacaatgacatattgccttacaccttttaggatggctattatcaaaaagtcaaatgataacaagtgttggcaatggtgtgaaatacagggaagagttgtacattgttggtaggaatgtaaattggtacaaccataatggaaaacattatggaggttcctcaaaaaactgaaaatagaactgccatatgatccaacaattccacttctcggtatatatccaaaagaaattgaaatcagtatcttgaagagatagctgcactcccatgttcattgcagcattattcataatggccaatatatgaaaacaacctaagtgttcctcagtagttgaatgtataaagaaaatgtggtgcgtatatacaatgaaatattacttgccgtaagaaaaaaaggaaattctgctgtttgggacaatatggtgaacctaaacgacattatgccaagtgaaataagccagacacagaaagataagtactgcatggtctcactttatatgggatcaaaagaagttaactcacagaaacaggagtaaaatggtggtctccaagggctagagattgagggaaatgaaggaattttgttccaagggtacaaattttagttataaaatgaatgagttctagagatttgatagacagcataatgattacagttaataacaatgcactgtaaacttgaaatttactaagagaatagatcttaactgttctcaccacacacacaaaaggtaactatatgaggtaatggatacattaatgagcttgagtgtggtagtcacttcacaatgtatacacgtatcaaaacatcgcatgatacatcttaaatataaacaatttttatttgtcaatatatatttatttgatagggaaaaataaaaaagattcagtgaacggtggaagcaatgaggactataggaataaaaattacagataggaaataagtttttagctgtgagctgggaatttgcatccccttggggtcattctaaaccggaatgcagttttggaatctgaaataggacaaacctactgacagacaggatccttatgaaagacagaaaaacaagaggaatttttgatggtcccacagtgaagagtcacaaaattggagcactggagaatcattcacagagaaaatttatccttccatattttttgttaaattttgaagctgtgatagataggaggtaaaaacaactagagatgaatttcttgcagtctcacaggattaatgaacaaaagacccatttacagtgattcctcagggatctagaactagaaataccatttgacccagccatcccattactgggtatatacccaaaggattataaatcatcatgctgctataaagacacacgcacatgtatgtttactgcagcactattcacaatagcaaagacttggaaccaacccaaatgtccaacaatgatagactggattaagaaaatgtggcacatatacaccatggaatactatgcagccataaaaaatgatgagttcatgtgctttgtagggacatggatgaagctggagaccatcattctcagcaaactatcgcaaggacaaaaaaaccaaacactgcatgttctcattcataggtgggaattgaacaatgagaaacatggacacaggaaggggaacatcacacagtgggaactgttgtggggttgggggaggggggagggatagcattaggagatatacctaatgctaaatgacgagttaatgggtgcagcacaccatcatggcacatgtatacatacgtaacaaacctgcacgttgtgcacatgtaccctaaaacttaaagtataataattaaatgaattaattaactttaaaataaaacattttattaaatatgaaaaaaaaaagaagaagaatccatgggaaaaacagggaggggtgtaaagttctccagggagtggtgaagcaactgaagatttcttaccatttttccatgaggatagttgctgatctggaccttaatagaggctgagaatcaggatcaggacttgctagatggctatttaccaggaacaagaatttatgagaatttggattccctgtataaggttaggatgacaaaatacaattaggttattttgccctgactttcaaattcatagtgttgtaataataaaatatatattcatttgtgcctggcttcctttgtgcaacctagtgttttagagatttattaagttatttattatatcagcagtttgttctttttaatatgattgctcagtgttactttgtatgaatataccacaatttgtttatcttttctgctgttggacatttgcattgcttctaagtgttagctgttatgaattaagctctattaggttattgtacatgtgctttgtgattatatgcccagatttatctgagtatgcacttagaagaattgctatgtgacatagtagtctatgttttatttcagtagatagtgtcaaagagttttctaaaatgattgtaaaaatgttcctttccaccagcaaaattctgcgcattttcactgacacttagtattcattattttttacttaaacattccggtgaatgtgtaattataatcttagtttgaatttaatttgcattttcctgatgaataatgatagtaatgtagttgagttccttttcatatatctttggtttgaatatgctactttgtgaattgcctgatcatctctgccattttaaaatttggattgtttacctcttcctgattgttttgtaggagtgtattatgcattctggatataagccttttaccagattcttgtattgtaaatatttttttccagtctgtggcttgcttattcaattcttaatcatgattttgagaaacagaagtttttaattttaatgtaattcagttgagttttatatttgttgtcattgcttttcctgtttaagaaacctttgcgtaatcctaagtcaggaatatattctgtttttttttttccccacacaagtttgactgctttaattttagatttaggtctaagatcaaattcacatttatatttaagaatagtatgaagtaaatctcaaggttcataatttttccatatagataaccaaacattctactgtcacttacagaaaagtccatcctcttttgctctaattaggtgactatattggagtgactggaaatatgtgggtatatttctaggttttcttttctgtccattggtctatttgtctaacaatgcacaattaactcctcaattaatataactttatcatgtcttgaaatttgagaatataagacctctaatgttgttctttgctatttaagattgtcttcgttttttgggggaacttttgtttctatataagttttatgatcagctcatcaatcttcaccaaaaaaattgctgacatgttgattgcaactatattaaatttatagatcaatatttagtaatttggcatcttaacaatattgaactttcataaactttctaatgttttaagtattctttagtttctccaaataacatttcaacatttttagaataaaagtcttgtatatcttttactgcatcattactatgtgaatttttatgaaattattaatcatattttaaatttttatttataattgtttattgttggcatatacaaacacaaataaattttctacattaaccttggatccacccaacttctttaatccatttttgaattataatggtctgtagattattttgaattttctacatgaaattatatcatcttagaataaaaatttactctttctgtattagtacgtattaccacaataatactatgtagaaagttgactttaaactcactgttctaataattattcatattgtgaatttgaaaatcagagatttaggtttggtgggatttttgtttgtttggtttgtgttttgtttgtttgtttgtttgtgtcttcctgagttacattttctgtctacagttggctggctatgcagtgaagctccatatgtcccacattcattcttcagaataacttgggcaagttctcatggtgaaagtagaggtgcaaaggtaaacaagtccaattatctaagtatgtgcgaagtctctatttgtgtcttgtttacaaacagcacgtggccaaagctatgaatcacaacattaagggctgagtaaaatttcctgcccagacttggacagtacttgaaacttgtatacgaaaagaacagatataaagaggggagaaagaatttgggctgaaattcaatctatcacactttcccaacctaatagctcatatttctttttgtttgatgagttagttcatcagtacaatgctgataggaagactgatagttaacatttatgtcgtgtttctatatgtaataggaaggatctggagtacatttttgatgaatataaaattttaagtttatggttttcttctttcagctcttcaagcattttttcctactgtctaatgaacagtctgtattaattttagttttgttcctgtctttataagtttacctgttctctctttttcaaaataaactgttaattttagagccattttagatttacagaaaaattgtgaagagagtacagagttgccattacccccataaatgcaggtttttcctgttttaacatcttacattagtgtggtaaatttgttacaattaattaggcaatatttatacattagtattaaatacatccatattctattcagattttgttcataatgttcttttttgttccaggatttcatctgaataccaaattacttttggtcatcatgtcttcttaagctcctcttggctgtgacactctcagacaagaattttgataatcatgtttttataaccttgacagttttctagagtacagtcaggtatttcccacaatgagagttgtatgatgctttcctataattagactgggatgatggggatacatggagggaaggcacagaagtaaggcatggaggtaaatcatcgtggaaaagctattttatcacagtatgccaagtgtacataacattgtagatgtaaaccatgattacctggatgaggtagcaattgcagattttcttactgtaaagttattctttttcctcccttgttatatagcaccatttggaagcaagtcactacgcataattcacaattgagtaataaagatttatgcttcacctctttgaaggtagagtatctacatatattatttgacattcatctctatttgttcagtcatttattcatatcaatatggattcatggataattacatgggtactttatactttggcttataatacaataccaccttttattttactgttcagatgtttccagctttggacaatgggagctctttcaggtgactcttagtccctttgacataatacatcattgtgtttagtatgtttgtttcactttttaaatttttcttcattttcaaacactataagatgccaaaaactcatcttgcatattaactgcccacgtcttagaattagatatttctctaagaagccctgattccttttgttggtagtgtcagtcctccaaatttgttcttcttcattattaggttgattatttattctaggtcttttatcttctcatataaacttcacaaaaaattttctactttttccattaaagcctttaatatattaattatagttcattttaatcccctctctgataatttcattgtcaactttatatctgcatctggttttgatactttttttctcttcagaatctgttcgttcttgccttttgccatgtttaaagtcagacatgatgtatcaggtaataaaaactgaagtacacgtttagtgtaaaggtttttgttaatctgggtgctttaaactgtatttaatatctgatgggctgtgcttaatgtgtatgcgtctgcaggtgtcagaggtttcaaatttctccagtgaccttatttttgtgtcactggttgacttgggcttccctcagtattcctcctcaaataatctttgtctcacaactcttttagctgaaatacaatgtattattttagagccctgtttttttggtggtaagttgtgaaggagaggaagcattctgtaatattaaaattaaattttgctattttattgggcctgtgctcctggctctgaccttcacaagtgtttcttaaattccttctttcactgtgcatgaaacaggaaggctcaagagggttgcagtgagagtaagcccattcctccaagtaggataaagctatggcaaagctttatcctgtggacagtaggcgtttgtaatagaaggatgctgttagcttatttctttttcccttcttctgctagagccacaaaaggatctttttcagatcttcactatgaggtcctggtagggttcctggaggtaagacacacaatgttccacctgcccttccactccccctgcctattgcagccccagcagtttctcattcttaaactcatctgcaatcagccatcaacatttcatcaaaatgaccaattaagtgtatttatcaatttatggctccagtggttttcactccaggtaagaagatttgtactgtgactcttgattcacatgtctctacattttgtggtgataaattttatcctgcaaataatttcttctctgatgagtccgagaaaactcactgattttcagtttgttgagttttttctttggtgtagagatgagagtcacaacttccaaactccgtgtaggagctgaagtcagaagtatttattgctttaaagattttgtagcactgttttctagcaatttgattatggcactacttaatgtggttttcactgtgtttatcctccttggcgtttagtaaaattattaaataagtaaggttggagttttatttaaacctggaaaccatagatgttattttcttcaaaaattttatgcttgtcttccttttttcttgtgttctaaagacccatatgttagaccatctgatactacatacacttgaagctctgtacaatttttttcagtctttttttcttatttttgcagtatctattctaatgttaaatgtatccagtaaattttttatttttttcactctagaagttctactttgtccttttaaaataatttttattttccttcattattttcttgtataactttacattttgagcacattaaacataatatttgtttcaaagtctttccgtgataatttcattgtttgattttctactgggtaaggctcacatatttccacttcttgtcatcattatacctattttacgggaattgcaatattttgaatgtatgttgctgtgtgttaggtctgttgtcttcctttaaaatgttggattttgtacaggcatgcagctgttacttgtggatcaatttgattacttgcaggcttattttaaagccttttgtaagagctcatttggaatagttcttactctggggatgggtaatccctactaccatactatagttcttttctggtttctgctgaatgtactgagtgatcaacaaatattcactccgcctttccagagctcaggtggctcacagcactatgaaagctgagaagtttttacctttctgcttactaggggtcgttttactaatcttaaacttccacctcatccatgcatagcttagtattcaaggggatccctgtacagatttctagggcttgtttccttagtaattccctcccctctacagcatctccccagtttttagtcatttcaccctccctcaaatctgatccctgttttctcaactcaacatatccactgcgctctatttgtcgtccatttaatatcatggttaagtgtggttaagaatttttctctagaaataaagctagtgggatcctggggctcaccctgcttatgtggcttctctcagtgactacagtcttttgctgcttgctgtccaaattctaaaaaaatttctgtcctgtatttgttcagctttttaattgttttggtgggaaggtaaattcaaccattttacttcataatgctcacaagctaatttttactttatgtgctgccgaagtgaacactccagaagctaattttaaaatcaaacttaagtaaaaataaaggaattattgaccatcagctaaatatttctttattatatgaggttctatcttaaaagcaattttctccctaaggtaagaaatgagattatgaagaacagtaagtggttgtaatctcttttctttttccttttttaatatggtgtttcaaatttaaacaatatctcttcactttgatatgaaaaataaggacattagatcctttgcctcatgcccttagtttattaattccattttatatgtttcataacattaactttgattatatagccacaacttgagaaattatcttgtatctgttctctatttaaatggaatcacatgtcatctacaatcattttatgatggctttccattccactattattttgacttcttatttaccttttaattagctcaaatttatcactcctgggtttttgttttgttttattgtttataagaaagattcatgctatattactcattattattcatggggttgttttttatagttgagcatctacaactttatcctcacaccagaatgaggtttgagctggatcacaattggttgtctttagaacttggtaaatactgctttttcttgatgttgtgtgtctgattttacttttttaaaatactgtactttttgatttacagatacagttctttcttcactataggagaaattatcataagtatttaaatgtatctgcgatttcatttaatgactttcctacttcaaacgtaactattttcattaggcttatctatattctggatttatcaggttctttctgaatggcctaattgatttgccttctttatctacattggttagagttattccaatctttttctctatgatgagaatttcagaagtaactaaagttttggctgtgtttatttgtcagtttgagattattgttctttagtgattttctatgtttttgcaagtctgcaatctcaattaaatatacctttcaatcctatgcttaaagtcgaagcttactaaattagtcataccaaattattctacattttgcagtgattggatataactcttgattcgtgaatattttcttcagcactgtgtacttcgtctacctttttgcatactatgctcttgctatttgttcttgtttgatacttatgaagcacaattgccacaccatttttttcttatattgctcacttttgggcagcagttttcacattctctcttctcactttttttttttacatctctcaagagagatgtaaaaacatttccttgaaataaacattaaattttagtttgttattttgtgcagtatttccccttgtatagcctaatggtggtggactgtggaaagactttaccaagaaaagatgagttgaaatgtaagcatttatttttagaatatcttaaatccattctaattgcttttgtttgttttgtttattaaagtcccgtaccaaggttttgttcatctactctggggggaagatcccataactgtgagagaacattttcaagccatggattatttctgtagctttgtgtgttaagtctaagactacagttttgtcaaggaaacatagtcccatggtttacttctcccccttctctacctccctccatctctcagaactattcctttatatcattatgttaaacatataaaaagactgtggttttttgaaaatggcacttgattgtgaaacaagagctctaatttgaagacctgcttttgacactagctatgtgacctgcagcaaatttcgttctcatctggaaaatttttgcagaggaaggtggtgagagtaaagtgatttgaacaatatgatttccacagtttaatttagctgtagtgttccataactgtgaatttctggacctcctgagtaacggctaaatataaagttggctctataaaaacttatgtgggtaaaaaatttgcaaagaagtaaatataatattcatatgtattatctgcatgatagtaaattccttggtatttataggtatctgagtacgttcagataccctgtagcagccttaactattggagcttttatttatatggatatatagacaaaattaagtgagaagctgaggaattatctgataatttagtctcgctaatagttttacctcaaacataagcaaatgggctttggagaatattattttgtaagaaaaccacttgagtttccatgtatacacaaagttgatggctacaaataagctaatagacaatgtttggttaggataaggagtaagccaaactacctcacagccagatcatttttgccttgattgacatctgtatacctctttcttggcattttgcttcaggttttaaaatggatttctctttttactagcctactcctttagagtgatggacactatgttgtaaatgaatcctttgtgcaggttcttttcagttaccttgaaaacagctccacattactttgcatttaggaataataaaaagagggatttgggaacttgcttttatcatgtggtagtggcatcatacaatattcccagcctgatcatgcatgagtgacttaagtggaaaatttattatggggaatattttccttacttaaaacactctattcttacagcgaaacagtaagaaagatatggttctatttataaacaactgaagcataatatctgcaatacatcacgtaaaggtataatcactgtcaaagtgccaaggtaccatcacagaaagtgactgctgtaattgacagagatggtgatcaggctccagaaccatttgccgattgcatattcatgattccactttgtaatatgctacagttcctctgtgagttattctaaatggatgtttaaacatcactagactgacactatgtattttgaaatttgcaagtctaatctttaacacctttctttctgctttgtctcagaatgtctaactcatgaaattggaacttagctaagggcctgaataggaggtttgtatgtatctgccattgtcacagtacagtcagataaattcggctctttttatgaattcagtccttaaattctttttgcaaccttaaagtaaacattggcagtcagttaaaactaacttctaaatgcaatggttctcttatcagcccctttacaaggataatgtaattttattttattttattttatttttttattttattttatttttttattttattttattttattttattttattttatttttgagatggagtctcgctctgttgcccaggctggagtgcagtggtgcgaattcggctcactgcaacctcgccctctgggttcaagctacatggcaaattttttagtctctcactgaaagatacttacatagctgtgagtaataattatcttaaatatcatgtccctagtagaatcatctctagtgttttagttttaaacccatgtgccatgtggtgtttcccctcattttgacaaattgattttagaatatattgagaagatctataaattatcctcaaataaatagaatttttacttcaaaacttaaacatatcagctttcccattggaataaaatgcaaatactatacagaatcaaatataatatgtcccaatactgaactttaggtttaatttattttcctcactatggtgagaaaaacagactgtatttataaagaaattcataaataatacgaaaaaccactttagtaggctgaagtagaggcaaaaaggagatgtggaaagccaataatgcatttcatggcattcaaaggaaatgggaattaagttttgtgttttttctaaattagggtatattcaaaagttcattcatgttaccaatttaatgtaatacattgcagttcaggttggttaataagtttcaaaagtaatataaattaaacacatacttccattagtttcaaattttgatgtatttcacaagtgctttaaatctcttaagaatatgcacataaaaatatattagttgtttatattttattaaaatatgatataactatataaaagtatataaatataaaatgatatatacaagagtataaatcaagaaggcacagctcagtgaatcttcataaagtgcataaaaccaataaaaccataacactatgtatttttaaattagtttataaaaaaattatctgattcaagaaactaaaaataaaggaatattttaagtagtctgtttttccaaattcctttcacttaacttgacagtcaagaaatcaggttaaaattttcttcaggctaatgttagagtaaaaggatggtacttctttaggtcatttgtctgtgagagacctggacttaaaccaagccaataggctcttctgtctggcagtctggcaaagctgtgttgatagaagcaattacgggtgagtcatgttaaccttaatgaaactcgagggataatcctggaacccaaattatagtttaatttctacaattacaattaatcttcccaattaggtggacatcttaatgttcatattttcctccatagccatatgcagatgctgctttctcatctttatatgccgtatgcacctgaaaacttccataattatttcaaaagcactgaagtccatcttttgttagaaagactatttccaaattatttgaatcagaaaaaaacatttggaaaaattcatttataaaagcaagttgataccattgggaggaaatttctctttcatttcccttctaggacctattgctattttttattcatttattcatccaagaaacttttattacatatcctttatttgcctagcatcatatcaggtataaacaaaattttaataatggcagagtatttgatcttatagagcttacagcctctgtaaaggtgttgtgaaggtttccattcatccatttattcaacaaataattactgaatttttgttatgtgccaggcaaattacaggcattttgaataagacattgaacaaaacagacaaaattcttttttcagagcttagattccaacaaaggagactgattataagcaaagtatacaaataagtatgcaatgtgatatgctgattatatctttggttttaattaattatttcactagagccaagcctcttttagtgtgacattgcacaacagttgaatctgaactagtttttaacttgttttggaaaatagaatgtgatggaagtgacagtgtggtggttccaaacataggcctcaagaagtcttgtagagactgggaaggattgtggggagggagggaaaagtcaagattgtttgtgggtgcaaaaatatagttagaaagaatgaataagatttagtattttatagcacaacatggtgactatgatcaacaataattcagtgtatattttaacataactagaagatcagtattggaacgttcttaatacaaaaagataatacttgaggtgatgaatactccaattactgtgatgtgattattatatattgtatgcctatatcagaacatcatatgcactccacgaaagtatacacctacaatgtgcccatagaaataaaaaattaaatatatatatgaacttattcatactaaaaaaaaaaaagctttgcacatttctactctttctgaatgctacctctcccatgcgagcaagctgtaaggtcatccttgaccacactgttcccacccaacccatccgcagacctcagataatatgaatttagctaagatcactgagttaataataatcattattatatgccattaaggctttgtgattatttgttatacagaattattagggcaatatataatggacacatatagaacataaaacaatgaagatttcacaggagaaaaaagtaaatcaaaacataacagtcaaaacaataataaaggagaagaataaagttggaggactgacaccacccaacttcatggcttactataaaacctcagtaatcaagacagtgttgtattggcaaaaagaaaatagacaaataaatccatggaacagaatacagagcccagacataaacccacataaatacagataattaatctttgacaaaggagaaaaagcaatgcattggagaaaagatagtattttcaaaaatggtgccacgggacattcacatgcaaaaaaaataatctagacacagacattatacctttcacaaaaattaactcaaaatttatcacggaattcaatgtaaaacacaaaactataaatctcctataaaataatataggggaaaatctatatgaccttgggttaggagatgactctttagatgtaacaccaaaggcacaatccatgaaagaattgataaacttgatttcagtaaaattaaaaatctttgctctgtgaaagatagtgtcaagagaatgaaaagataatgtatagactgggagaaaagatttgcaaaagacatatctgataaaggactgttaagatatacaaaaagctctgaaactcaacaataataacatttttaaaatgggccaaagacaaacagatacctcaccaaagaagatatacagatggcaaataagcatataaaagatgcttcacattatatgtaagcaaggaaatgcaaattataacaacagtaggatgccaccacagacctattaagatggccaaaatccagaacactgacaacaccaactgctggcaacgatgtggagcaacaagaactctcaatagttggtgagaatgcaaaatggtgagctactttggaagacagtttagcagtttcttccaaaactaaacatactcttatcatagatctaaaaatcacactgcttgatatttacccaaagaaactgaaaaattatgtccacacgaaaacttgcacacagatgtttatagcagctttatttataattgccaaaacttagaagcaacccagatgtccttcagtagacaagaagataaataaactgtgttacatccagacaatagagtattattcagagctaaaaagaaatgagctgtcaaaccatgaaaagacataaagggaatgtaaatacatattactaagtgaaagaagccaatttgaaaagctgcatactgtatgatttcaactgtatgacattctggaaaaggcaaaactatggagacattaaaaagatcagtggcgtcaagtagttggggcaggaaaggatgaatgggcagagcacacaggatttttaggtcagtgaaaattctcagaatgatataatggtggacacatgtcattaacatatttgttgaaacccatagaatgcatagcattttctccacagaggtgagactttgattatatttttaaaaataattacatattcttcatgcaaatatatgtttgaaccatgctgagggaaagcattacaaactcagctaggaatacaacatagaacattcaatgggttattaattattctgtaggtttgaagtatgcaattctgaggatagattgagaatggaggaaataacagaacttaaccttggagtacagggtagcgaacatccaaaatctgaaatgctccaaaatctgaagtttctgttttgtttaacttgtattttagtttcaggggtacatgtgcagatttgttatataggtaaacttgtgtcaccgggatttgatggacagattattttgtcatccaggtactaagcctggtacccaatagttaattttcttaaacctttccctccttccatcctcccactgctggtaggcccaagtgtgtgttatcctctttgtgtccatgtgttctcatcatttagctcccacttataaatgagaacatgtggtatttggttttctgttcctgtgttagtttgctaaggataatggcctccagcttcatccatgttcttgcaaaggacatgatctcattctttttatggctgcatagtataccatggcatatatgtaccatattttctttatttagtcttctgttgatgggcatttaggttgattccatgtctttactattgtgaatagtgctgcagtgagcatacacatgtctttatgacagaatgatttatattcctttgggtatatacccagtaatgggattgctgggttgaatggtagttctgtatttaacttttcaaggaatcgccacactgcttttcacaatggttgaacaaatttacactcccaccaacagtgtataagaattcccttttctctgcaatcttgccagtatctgtaatttcttgactttttcataatagccattctgactggtgtgagatggtgtctcatcgtggttttgatttgcatttctctaataatcagtgatgttgagctttttttcatatgcttgttggccacatgtatgtcttcttttgaaaggtgtctgttcacattctttgtccactttttaatgggattgtttgttttttgcttgaacgtttaagtttcttaaagatactggatattaggcctttgtcagatgcataggttgcaattactttctcccattctataggttatttgtttactctgttggcagtttgctatgcagaagctctttagtttaattagatgccaaaagtttttgcttttgttgcagttgcttttcgaatctttgtcatgaaatctttgctcattcctatgtctagaatggtattgcctaagttttcttccaggcatttgatagttttaggttttacatttacgtttttaatccatcttgagttgattttatatgtggtgtaaggaaggggtccagtttctgttttcttcatatcactagccaattatgccagcaccatttattgactaggaagcctttccccattgcttgttttgtcagcattgttgaagatcagatggtcttagatgtgtggccttatttctgggctctccactctgttccatttgtctatgtttctgtttttatatcagtaccatgctgttttggttactgtagccctgtagtagagtttgaagttgggtagttttatgactcctgctttgctcttcttttcttaggattgccttggctagggctctctttgggttccatatgaattttaaaatagtctttttctggttctgtgaaacatgtcattggtagtataataaaagtagcactgaatctgtaaattgcattgaccatatagccattgaaatattaattcttcctatccatgagtatggaatgtttttacatttgtttgtgtcatctctgatttccttgagcagtgttttgtagttctcactatagagatatttcacctttctggttagctctattcctaggtattttattctttttgtcacaattgtgatggggttatgttcctagtttggcctttgtttggctgttcttggtttattggaatgctagtgatttttgtaccttgattttgtatcctgaaactttgctgaagttgttttccagcttaaggagctttggggctgaaactatggggtttgctagatatagaatcatgtcatctgcaaacagggatagtttgacttcctctcttcctatttggatgccctttctttcttttggctgattgctctggtaaggatttccaatattattttgaaaaggggtggtgagagagagaatccttgtcttgtacttgtgttcaaggggaatgcctctagcttttgcctattcagtttaatgtttattttgaggtatgttccttcaatacctagtgtgttgagagtttttaagaaaggatggtaaaatttattgaaagccttttatttatctaatgagatgatcatgtggtttttgtctttagttctgtttaagggatatatcacttttattgatttgtgtatgttgaaccaatcttgcatgccagggataaagcctacttgttcatggtggattagctttttgatatgctgcttaattttgtttgctagtattttgttgagaatttttacatcaatgtttattgaggatattggcctgaagttttacttttgcgttgggtctctgccaggtttggtatcaggatgatgctggactcatagtatgagttggagagaaatccctcctcctcagtttttggaatagttttagtaggtatggtactagctcttctttgtacatctggtagaattcaactgtgtattcatctggttctggtcattttttggttggtagactatttattactgattcaattttggaacttcttattggtttgtgtagggattcaatttcttcttgtttcagccttaggagggtgtagtatccaggaatttattcgtttctttgagaattctagtttgtgtgaatagaggtgttcataatagtatttgatggttatttttaattctgtgggttcagtagtaatatcccttttgtcatttctgaatttctgattgtgtttacttggatatgctctcgtttcttttttattagtctggctagctatcttactatttttttccaaaaagcatattctggcttcgttgatctttctaattttttgtgtgtctcagtctccttcagttcagctctgactttggttatttcttgttttctgctaccttgggggttggttttctctttcttctctggttcttttagttgtgatgttaagttgtcaattagatctttctaactaactttttgatgtgggcgtttagtgctataaattatcctctgtacactgctttagttgtgtgtcccagatattctggtatgttgtatctttattctcattagtttcaaagaacttcttgatttctgccttaatttcattatttacctaaaagtaattcaggagcagattgtttaattttcatgcactgtatggttttgagtgattttcttagtcttgaattctatttttattgtgctgtggtctgagagaatggttggtattattttggttcttttgcattgatgaggattatttcatgtctgattgtgtgattgataaaatctgaagtttctgagcactaacaaacatgatgctcaaaggaaattctcattggagcattttggattttagatttttgaattagggatgttgagccagtaagtacaatgcaaatatgccaaaattcaaaagaatccaaaatcttaaaaacttcttgttgcaagcatttagaataacagatacttaacttgtatctgtgatactgaagttagataatgaagaacgttgtaaaccattttaaagaattataaatattatagtacctaatggggagaaagaagaagattttgaacacaagagtgacagtctgagttgcatttttaatagtgtggagcgtggacataggagtaagtgaaactcgagacatgagaaacattgagaggctatttcaagagtcttaatatggaataatggggatgtagacattatccataggaaggaatatatttacacaggaattgtaaggctatatttgtttttaaactcttactgagtatactttccctaactcagctccagacatatgggtctctctacttttcctcaatatgggagatatgtccctaattcagagtctttatataggctgtaaatcctggtaccgatgtggcctatactctcttcttcattaaagtattgcttaaatcttatcttctcattaagtcttaccttaagtcttcaattaaagttgcacaccaccatttcctactatggtagtttgcagtactttttcaaaacactttttcaaaacattcttttattgcaatctaaaaacactcctctgttagcgtgtgacttcaagtgcctcactgtaagagaaacaaatattctcgtgccagtgacactggatttggccatgtgtcttactttggacaatggactgtagaaagacaaaatgtatatcacattctaggctaatctttgaatattcctctgaaatattcagtttttatttttttaaactcttccattagtatagcatttaagcctggatcctaaaataaagaagacatgtagagaagaaccataggaaactagagctgttacaatctaattagttatgagagagaaataaaactttattcttatatccatttgttttactaaaatataaagagatgtacatcaactgatatagaaaatggtaagtagaagtaggtttctttcataagaaaaatcctacaatacatgggatcaaatgtggtcttaagtaagctcctgttgaacactcaaatgatagaaagccatgttatccagtgacagaacattgagtaaaactgtcacctgtagtatttagtacagaaaatgtagtaaaactgttactgtgatatgtcacctaaggaagataataagttgatggttactgggcttcacatagtttctatcagctacatctgattgggtatttaaaaaacaaaaaaaaacaaaaactcagaaaacaattaactggccagcaagcatgctaaaagggaaaagagaatccaaaaatttcagtagctacagtatagaaagatgcaactctcataacaaaaaggtaagaaaaaaatcaagaaatgctttgagaaacaatgacaaataattaaggcaaccttaaagcaaaagccaacttgagggcatgccaatcttattatttgctatagcctctgaataatttcagttgattcatgataaatcctttcaattgactaaaatggcttagtgaaaataaactaatagtgagcttctttcacattatccttataaattaaacataatgagaatgaaatttatagaacatatctttaatctttaaaatactctatactttttgatgtgtctattggcatgtagaaaaaattgccatcaagtaggtaaaaagccaaaaaaaatcttttttcagtgaattgcactgccaaatgaaccatcagctaaaaatgaacgactgttattatcaaattttaaaataactcttggattcctaaacttctacaggcaaaaacaggttgagacattaacttattccaatagaggatatagtctccttttcagatgtggccaagaaggatactgaacttcaagggaagagccaagattcaaaaagaatggatggaggtcctcctcctatgcagtagaagttttactttcaagaaaatgcttttcatccaacatagaagactcttgcaaatatctgtatttcttggtttcagaatttttacataccagtaatggcaatgttcctcctattctttccttttctcaaaggaagtgtttattgtcataaatatgtccttgtttctccattatatcttaaggatggagacataaccttccattttattcacatatctttagactaagaaaagtgatatgtaaaacatatttaaaattgtggacattaagtgaatattgaggtatctttgtatctttcttagtgatggggcgaatgatgttgaataaaaaaggaaggaaacttaatatctgttaccaagatagtagattctggtatattagagtattagataagactatgtatgagagtgttgctcccattatatatccacctcacctgactgtaggaatattgtatttatgtttcttccttttcttaaaaaatggcattctttctatctgaatactgaaattaaccagacatgtggagcagagccagagctgacctaccactgctgcagatcatatcaagtgagagtgagaaatatttctgttgcaaatcattgagtttgttaaagtcgtttgttaccacagtaagaactaacacacccgctcaatttcaaactcattttttcacaattccttttaatttgatctttatttttttattaatgtgatttttctcctagtacatattactttcaacatccaatatagtttatgcatttataatggttattgtgaactgtatgaccattttattagattataagccataagaagtcagggattctttcacattttgtttggtaatgtatctggagtacaaaaagcaaaatatggacttaaatatttgtagaatgaatgaatcatgctgtcataaaacttgtggcaaataaatgctagggaaaaaatttggaattaagctcatcctgtagaggtaacctatattaaaaatttgaaaattctaacacatagcaacagttatcacgaatgttattggtggagggatagaaaaatagatcaatgaaacagaataaagaaaccaaaaatagatttttgcttaaccgatttttgaaaacaggtgcaaaggtaatgaaatggtagcagcatagccttttcaaaaaatggtgctagaagaaatgtacatctagaggcaaaaaagaaaaaaaatgatatctttgacataatattcacaattatttttaaaaactcagaatgaattatggatttaaatgtaaaacatatcctgagactttgctgaagttgcttatcagcttaaggagattttgggctgagacgatggggtttttctaaatatacaatcacgtcatctgcaaacagagacaatttgacttcctcttttcctataagaataccctttatttctttctcttgcctgattgccctggccagaacttccaatactatgttgaataggagtggtgagagagggcatccttgtcttgtgccgattttcaaagggattgtttccagcttttgcccactcagtatgatattggctatgggtttgtcataaatagctcttactattttgagatatgttccatcaatacctagtttatttagagtttttagcacaaagcaatgttgaattttatcaaaggccttttctgcatctattgagataattatgtggtttttgtcattggttctgtttatgtgatggattacatttattgatttgtgtatgttgaaccagttttgcatcccacagatgatgtgctgctggatttggtttgccagtactttattgaggatttttctcatcaatgttcatgagggatattggccttaaattttcttttttagttgtgtctctcccaggttttggtatcaggatgatgctggcctcataaaatgagtgagggaggagtccctctttttctattgtttagaatagtttcagaaggaaaggtgccagttccttgttatacctctggtagaatacggctgtcaatccatcccattcttggcttttttttggttggtaggctattcgttcctgcctcaatttcagaacttgttattcaatttcagaacttgttattggtcttttcagagatttgatttcttcctcgtttagtcttggaagggtgttttagtcttgcaagggtgtttgtgtccaggaatttatccatttttctagattttctaggttttttgcgtagaggtgtttatagtattctctgatggtactttgtatttctgtggtatcaatggtgatctctcctttacaatattttattgtctccatttgattcttctctcttttcttgttagtctgtctagcagtgtatctgtctattttgttaatcttttcaaaaaaccagctcctggattcattgagttttgaagtgtttttcatgtctctatctcctacagttctgctctgatcttagttatttcttgtcttctgctagcttttgaatttgttttctcttacttctctagttcctttaattgtgatgttagtgtgtccattttagatctttcccgctttctccagtgggcatttagtgctataaatttccctctaagcactcctttagctgtgtcccagagattctggtatgttgtgtctttgtcctcattggtttcaaagaacatctttatttctgccttcatttcgttatttacccagttgtcattcaggagcaggttgttcagtttccatgtagttgtgcagttttgagtgagtttcttaatcctgaattccaatttgattgcactgtggcctgagatactgtttattatgatttccattcttttgaatttgctgaggagtattttacttccaattatgtggtcaattctagaataagtgctatgtggtgctgagaagaatgtatagtctgttgatttggggtggagagttctgtagatgtctattaggtccgtttggtccagagctgagttcaactcctgaatatccttgttaactttctgtctcagtgatctaatattgacagtggggtgttaaagtctcccactattattttgtgggagtctaagtctctttgtaggtctataagaacttaatttatgaattttagtgtgcctgtattgggtgcatatatatttaatatatatttaggatagttatctcttcttgttgcattgatccctttaccattatataatgcccttctttgtcttttttaatctttgttggtttaaagtcagttttatcagagactagtattgcacctccacttttttgtttgtttgtttgctttccatttgcttagtaaatctccatccctttattttgagcctatgtgtgtctttgcatgtgagatgggtcagctgaatacagcaaccgatgtgtcctggctctttatccaattagccagtctgtgtcttttaatcgtggcatttagcctgtttacatttaagattaatattgttatgtgtgaatttgatcctgtcattatgataccagcaggttatttcacggacttttaaaggagaactacaaaccactgtttaaggaaataagggaggaaacaaaaaaatttccatgctcatgggtaggaagaatcaatattgtgaaaatggccatattgcccaaagtaatttatagattcaatgctatccccatcaagctaccgttgactttcttcacaaaattagaaaaaactactttaaatttcatatggaaccaaacaagagattgtatagccaagacaatcctaagcaaaaagaacaaagctggaggcatcacactacctgaatccaaactatactacaaggctacagtggccaaaacaccatggtactggtaccaaaacagagatatagaccaatggaatagaacagagccctcagaaataacaccacacatctacaaacatctaatcttcgacaaaactgacaaaaacaagcaattgggaaaggacttcctatttaataaatggtacaaggaaaactagctagccatatgtagaaaactgaaactggaccccttccttacaccttatacaaaaattaactcaagatgaaagaaggacttaaacatcagacctaaaaccataaaaaccctagaagaaatcctaggtgataccatttagggcataggcatgggcaaacactttatgactaaaacagcaacagcgatggtaacaaaagccaaaattgacaaatgggatttaattaaactaaagagcttctgcacagcaaaagaatctatcatcagagtgaacaggcaacctacagaacgggagaaaatttttgccatctatccatctgacaaagggataatatccagaatctacaaggaacttcaacaaatttacaagaaaaatacaaccccatcaaaaagtgggcaaagtatatgaacagacactactcaaaagaagacatttatgcagccaacaaacatacgcaaaaaagctcatcatcactggtcattagagaaatgcaaatcaaaaccacaatgagaaaccatctcacaccagttagaatggtgatcactaaaaagtcaggaaactatagatgctggagaggatgtgaagaaataggaatgcttttacacttttggtggcagtataaattagttcaaccattgtggaagacagtgtggagattcctcaaggatctagaaccagaaatgccatttgacccagcaatcccattactgggtatataaccaaaggattataaattattccactataaagaaagacacagcacacaaatgtttattgaagcactattcacaatagcaaagacttggaaccaacccaaatgcccaagactggataaagaaaatgtggcacatatacaccatggaatactatgcagccataaaaaaggatgagttcatatccttggcagggacatggatgaagctggaaaccatcattctcagaaaactaacataggaacagaaaaccaaacaccacatgttctcactcataagcgggagttgaacaatgagaacaaatggacacaagaaggggactatcacacactgaagtctgttggggggtagcaggataggagaggaatagcactgggagaaatacctaatgtagatgaggggttgatgggggcagcaaaccaccatggcacgtggatacctatgtaacaaacctgcaagttctgcacatgtatcccagaacttaaagtataataaaataaataaataaatgtaaaacataaaactataaaagttttagggaacaaaatgaagaaaattttcaggttttagggcttggcaaagaattctgagattggacaccaaaagcgtcatccataaattgaaaaactgattatctgaatctcatcaaaatttaaaacatttgctctcccaaagaccctgttaagaaggtgaaaaggccgggtgtggggcctcaggcctgtaatcccagcactgtgggaggccgaggcgggtggatcacgaggtcaggagatggaggccatcctggctaacaaggggaaaccccgtcactactaaaaaaaaaagtacaaaaaatttagccggcgtggtggcgggtgcctgtagtcccagctactcgggaggctgaggcaggagaatggcgtgaacctgggaggtggagcttgcagtgagccgagattgcgccactgcaccccagcctgggcaacagagtgagattccatctcaaaagaaaaaaaaaaagagggtgaaaagaataaactagggaacaggaaaacacacacacacattactaaaaaaaggactggtacctagaatatataagacctctcaaaaatcaaccttaaagtaatcaaacactccaaatagaaaatgtgctggtattttattgaagaagacatacagatggcaaataagcaaaggaagtgatgttcaacattacctttaggcaaatgcaaattaacatcacaaccagatatattagcttacctgcctgaatggctaaattaaaaaataaatgctggaggggatatagagaaattgaattactcatacactacctgtgtgaatgcaatattgtaaggccaatattgaaaaaacaatttggcatttcttataaaactaaacactcaattaccatgtgattaaacaattgtacccttgggcatctgtcccacaaaagtgaaaactatgtgcacatgaaaacagtcacagcaggccatgcgcagtgactcgtgcctggaatcccagcgctttgggaggccgaggtgggtgagtcacgaggtcaggagttcgagaccagcctgggcaacgttgtgaaaccccatctctactaaaaatacaaaatattagccgagtgtggtggcaggcacctgtaatcccagctactcgggagactgagacagaagaatcacttgaaccagggaggcaaaggttgcagtgagctgagactataccactgcacaccagcatgggcaacagagcaagagttcatctcaaaaaagaggaaataaataaaaattaaaaataaaaacaattatagcagttttacttataacagccaaaaattggaaacaacttggatgtccttgtacaggtgaatggttaaacaaattgtggtatacccatacagtggaatgctaattagcaataacagggaacaaattattgacataagcaacaacttggatgaatcttaaggaaattctacagtggaaaaaggcaaaatcaataatatatatactgcaaaatcaataatatatatactttatgaatttatataacattcttgaacatattatttagatgaataacatattagtggttgttagggatcagataagggttggtgttggggaagggaagtggctgtggctataaaagtataaaaagggatctttctttgtggtgatggaactgtttttttatcttgactgtagtggtagattacagagaagtaaacatacacacacacacaactgtagtggtagattacaaagaagtacacacacgcacagagtactttaaagcaggttaaatctgaataaaattaatgtcaatttcacagttgtaatattgtactgtagttttgcaaaatgttaacactggaaaaactggccaaatagatatcccatgtacccatgggatatctctgcagtatttcttacaactgcatatatatactactgcctcaaaataaatagcttcgttaaaaaatggttaaatatataattaattattatataaatcatcaagtctacttctacatatttacccgttagaaatgataatatatagatatgtccacaaaataacctgtatgtaaatgttcatagcagtattattcataatagtgaaaatctaaaaacaatcaattatctggaaataagtaagaaagagtgtgagaaaatatcttggtgaagagtattctacctagcaagaatagaaaatatacataacctaacatgagatccagattggtatattcaaggactatccatgaggtcggtgtggctggggtgagaacctaaatgagtggtaagaaacaagggcagatagacacacaatggatgtgagaggtgtgggcagacatcattcaaagtcatttagactcttactctcaataaagggtcagccacattcaaagtcatttagactcttactctcaaaaaagggtcagccactgggggtttgggcagaagaatatgacctaacttttatgttttaatgagatttctttacatattgtgtgaaaataatgtcatatcatactatatgggaaatttttcattattttaagacctttaaattcaggttttgtttctataaaaatggtattttttcaagttccaggaattaccttgacaatcaaaatgttctcctgtgagcacatttcagagaatatccattcatccactaaaatgaaattctcacttaaactttctattatcatgacattttagagataagaatttagttttacagattccaaaactaataacataattacaaaaagacaaaatcagaataactgcaacatagttgtaaatgtatataatcccccaaatgacttggaaatgttgatatatgttacacatttgagggaatttggctgatgtttttaaaaatttcttttttgttttgtatgtgaataaaaatagcacagacccaagaacaaccacatggtgccatgagagaacagaagtcacaaagcacacaattaacaaaacagtatcaagtcaatacaaatcacttaattttgctaatgactgtcatgcatggtaaaaatagacaacaagctcccttctggcagaattaacaagcacactacctaatatggaacatagaaattatagtaaataggagatgagaaaagaacaagaagagaagtaatgaggaagaggtggaggagagaactcatttaccatagcttatacacagaccccatcgtttagttcatcagtaacatcgagactgcgatgtgatggaagaaaactgcaaaaaaacaactgctcaacacacacatcccggcagggtccaaaattaggtcacagcaatcccaaacaaacaccttactgagaaaaaaaaaaaaaaaaagggaaacctattgacaactattctataaaactcttatccaggtagttattaaggagtcagtttgtattttcaagtcttgtcttgaaagccctagttttactttgttttctcttatgaactacttggattccttctctttaaaaatatcaaaacaaatatctttggtgttttcaagaaaaaaaaaatgttcttccaaatgaagagcacatttttattcctttttaaaaatgtattgactttcatataattgtatttttgcttattctgggggaaaaattctaattatttcaatcagcttttctctcactggtagcagaaaaacccatagctatttcacatcaggttaaggcagtaatgttcagctaaaaattaacatttatcaacctcctccatgactgccccccaaattgccatataaatacatattcatttgccaaatatatcatattcattttcaaatatttcaaacatttgcagcccctactgtgggctgcagatccagggacagatacaaccaagtttctgccatcagcttagtaatccattgtgggagacaagcatatagatacatataaaaatacctaattcagtttaacatttacttacccaaaacaccttccagaacccgcggattaggtggtttctcttatgtaacactgctaattttatggaattgaaagtcattcactcattcatacaataaataattctggggtgctacttagtatatgccaggcatttttctaattactgggggtgcctaagataaaaaacaaatctactgccttcattgagcttaccttctgttgctggggagagaaaagcaataaacagattatataatctctgatatactagttgttatgaagaaaaccaaacagggcaagggaatagagagtcattggtgattgctgtagatagataaattacaaaagccccatttacaaaagtgacattattcaaagatctgaaaaaaattatattagttttctaatgttactgtaacaaattaccacacagtgacttaaaacaacacaaagttattatcttataggtcacaagtctgacatgggtatcattggactaaaatcaagatatcggtagggctgtattgaggtcctcgaggaaaaataggtctctttgccttttccacctctagaggttgtccacattctttggtatatggtgtctgttacccatctttaaagccagtgagtcaagtttcttctcacatttctcttattcttattccagcatcacatctttatatgccattctccccttttcaaagtccttaatgttaatcacatccccaaaattccttttgccatgtgtagtaaaatattcacagggtccaggaattagaccatgagcgtctttggtgtgggctgtattattatgtctatgacagaaataaagtgatatatataaaaatctaggggcagatactcaagtcagaatagtaggcaaatgcaaagacattgaaggaaaaattgatataatagcagatttagttcctgattctaagtaagcccacattgaacattatttggccaataaataaatgaatgagatgtgttgcccacagtagtaatcaatgcattttctgttgtctcccttctgccctttttctgtgttctcatccttcctctctcttctctctccctctctccctcccactctgttagaaacaagggtgctataaacacttaaaaatcaaatgcttggggaatgccagtgatgtccttgggatagaggcacagttgtttgaaaatattacaggattcactttaatgtcaagaaatcagctctagtctaatgatgcttcacgatgcatgtcttgccagtttttaggttatgatttggccagaagaagtgctgcaaaaacatatagaagattatttgctattcttttgatctacttccatatggtttgtaaaattcacacttggattgattggttcccccaagaattttcaattttatcagatgaagctataccctgtagcccttgtcatgcttgtgaagaccacacaccaaatatgaagacaatgttactacttatcccttccaatttctcataagaatgtcaaatatcttacttcatattcaactttcactaacagtcactgaattactattaaatctggtttctgcacattattttatctaattcctacatctacctattaataggagttaaattcttttttatgcactgtagaaaatcaagtatagaagggtcaacaaaacaagatacacaagatggatataataagctactgcttacaaaaggaaagaatacaaatatgtgtcttgcgtggggtaggcattgcttatttgtttttaaagtaggaaaaattgaagtcaaaaatgtaaatggttttctattgaggacaaactagttccatacagaggagaacagatagctggattttgaaaagaagaatttagacttctctaaatttaattatttgtagatttgactctggaaccatataaacctttcaaataattttaaagccaagctaagtatataaaataatctataaaataatagcacagttaaataaataaacctatctttcaagctactggcatgactacatagaaagaagttatttcaaatgattttaagacatggtaatttgactgtacattctgagaatgaaaataatagaataaaaactattaaactctttttagtatttatattatagacggtagtgttagtactattattctgaaaaggttatgtgtgcaaagtgaaataaagtgaatgaataattatgatgtgttgctgggttcttggatttctcaccctggaagaaagctgtacagaactggggagattaaatggaaatccatgatcctgaatttgaatgggagtcaccagtatgaactcatgtcctattttttttttctttaaacaacaagaaagcttacattagctctgtctagagaagatcagtggaacacatgccacttttggtttctagcaaatgcttaataaatgcaagatattattctctcagttttgagttgtattgctaaaatatcttactgagaaagaggagctaaaattcaagcataactagctgctgtaaaaatatcacttatgcttgaactcttcgattaagagtactttaactcaaagtatattaatactaaacaaacagaaacaataatcttcatgaaaagaatgaattctccttcatccgtagcagtaggttctgggaccggacagtgaggtttatcaggaaatctaattttagccaataaaatttttacattctatatgtaggcattttctaagaactatgagcaagtagtcaacttatttttattttcgtcttctttttttttttttttaagacagggtctcactctgttgcccaggctggagtgcagtggcatgatctcggctcgctgcaaccttgacctcccaggctcaaggaactctcccacctcagcctcctgagtaaatgggtctacaggcatgtgccaccatggacatctaatttttgtattctttgtagagatggggtttcacgctattgcccaggctgatctcaaactcctcaactcaagtgatccattcacctcagcctcccaaagtgatgagattactggcgtaagccgacatgtctggccttactttcatctttaattctctttcgcattgtcaaatagaagtgatcatgcaaatttccaagtccaaatagagctcttcatgagagagaaagataattgcctaccagtaaggctgtccaaactagtttaatactattccttgtcagaccacaagatgagtatcaaataatcaccatgtcttaggatcacatctttcttgttctgattttcttttatcccgatctcattcttgctatctttattttctcatctcatctctgaaaccttaaactgaaactttccattgtctcactggaaatgacatagtgcatgaagccatgtacgagctacattgatagcttgattctcagttatttcagaagatttggctggattttgtttaaatcactagtcttcatgtttcttatggaactatgtttacttctcaccacagccaatgtggtgagaagttcattaaaatgtgttcaatgtctatttttgtggagaaagttttaaagtacttgccttaaacttttggaaagtatatcagcatttctgtgtgaatatacttgtgtgtgtatatatatatgtatatgaaggcacagtgtataggagacaggcagagggatgagtgcacattaaaaatatgtagacatgaattctagccttgatgccattcataactttgcaatgtagttttgggcaagcattgcatctcattgtcctccctttttaaatgcttactatgtggtaggagcagaatgggaacggttaacagaatgactaacatatactatttgcccttaaagaactcctaatctacatagtctactgacaaaataaactggtaaatccatagtcatggggaaaattagcacatatgcatctgtgccctgcattcataatataattcaaatacaataacaactcaatgacatgtgtactattactatttgcatattgtaaacaaaatgactaaaacatacattttaatgacttttccaaagtccactagttaataaatgcagtgattcaaagttaggactgtttgacaccagagggccacttttaaacatcatgccatactgcctcacttatccactacaatattatagcaatgatagaggtaacaaagagtgctagacttttctttttggttcctttggtccagaaactgaagagaatagttcttttagggaaaggtgaagtgacatttgaacttggcatgaaaatgtagattgccacttgaggaaggaattgataataagacttaggcaaagaaaagggaaaaggaagttcagagaaagatggtattactgtagctaggatttagaatattcaggctagtctggtgaacatgaagaaagaatcctagatataaggaaagaagtatcagattgggggaggattctaaagaatcatatatagtagtgcttctcaaattttaaagtgcatgagagttacttgaggtgttcattccaatgaaaattctgactagaaaagtctggggaaaagcctgatagtctgcatttctaacaagcacacaagtaatgatgctcatattttgagcatcaaaattatataccatacaaagaaacatggatttgttcaaatattgaatatgcaattgaatttttatgggcaagggaggaatatggtcaggtttctatttatttcaaaaataaacaataatttttgcatcactgctcagggtgactttcctaccttctatacagaaatgcatagggccaaataagatatactaggctttgaaattatttattgccaaaatatactagatattattagttaggatgttcacctttccttgatatataatcttttcaatatacactaaaagatagataggtcttcaatgattctaagtgaagtacaagatactaaattgattcacacccttgtataatatttttagttgccaataaacatgattggatgattttatgcattgatggaggtctactattggtttgccaaatgggacaaatttaagcttgtgaaggaaaagaagattgttgtgcctgccaaatggtttagacacagcaagcagagacttaaccactcagcagggtctccatccaatatctacgactgctgtgtgtgtgtatgtcctgcacttcaaagaagccagtttcgaacaagagcccttgagattcataatcagtaactcccacaggctttacagagatatgcaccatttggtttaaaggcatagcagtagcatagttgtaataggacagcatatttcttttccccaaagggtggtgagtcaaggaaatatatattaattattattagaatacatacaagacccctcatcaagatctaaaagggacttcaaaaatacatgactgctgccatttacaaattggtcacttgatgcacacaaaatatttgctccaaatcacagattttaacatggagggttgggtataaaagactgctctttacattcctaggaatttagcttccttgaggatagaagtaacactgtgatttctcctgtgatatgatttttaattccaaatgcttaatggatatttcctctttgatatctctctcttctgaactcacgttcccgtgctttcacgtcctgaatttaacttgttagacttctcattacacaaaaccaaacatgttctctttcttttatatcctttctctgattgcaacataaaacgcatcgagctgcccaaagccagaaaactcaaagtaagccctgacctacaaatgcatgaatctgatcctaattggcatacaaattagaaaattgagctaatgtgcatacctccacacagcttccaagctgaattctgggtgccacacatgggggaccgatctatgtagcagggcaaactttaaccattcagctaacatttaaacatagcccatgtagttgagttggacattctggtctcaaccaaaacatgacaactgcctgcaaaaatatcaacattatccacaggatttaaaaagaacccagagtctcataatataatattcaaaatgtctaggatataattcaaaattactcagcagaataaaaagaatcatgaaaatctcaacttacttacatgtcaaaagatgataaccaaccaatacatgccaatgacgaagtgatacagatgttggaattatctaataaagactttcaggcagctttttaagaaatgttgagcgagcaactttggaacaaacttacttagaatgtaatagcaaaaatataatataaagaaagctcaaatggcaagtcaccaactgaaaaatacaataaccaaaatagaaaattcactggaagaacacaatagcaaaataaagataataatctgtgaatgtgaagatacatcaataaacctgattgaatctgaacaaagaaaatactgattttaagaaataaacagaacatcaggaaactattgaataatatggtctaaaatttgtgtcattagggttccagaaagagagaaataaaaagagcatagttctaaaaaaaacttttgaagaaatgatggctgaaaacttactaattttggcaaatacataaacttataggtccaattggttcaggaactgtaaacagaatagccccaaagaaagtaatgcctagacatatcataataaatgtagtgaacacaaaaaacaacaaaatcttgaaagcatccagaaaaaatgacatgttaccaatgggaaaataatgattcaaataaccgtatatattttcatggagactagaaggaaatggcacaatattttgaaagtgttgaaagaaaataattgtcacctcataattctttatcctgaaaatatccttcaggacgaaagtgaaataacattctgagatggagtaaaactaaaataatttgtggctatcacacctattttaagagaattgccaaagaaaattaattatttagagaataaggaaaatataccagaaagacacttggaaaatcaggaataaagagcaacagaattaggaaatacctgggtaaatttaatagaccatttttctcttgagttctctaaaatacatttgacagttgaaagcaagatatttagcattagctgatggagttacagagatgtaacataagacaattacaggctcgtgacatcagcaaggtgaaatatgaagccttcatcttgtatccccacatagtaaccataatttaacagccatcatgggaaaaaagtgcctttgtaggagctttaggatccaggtaggaggttgcaaaaacccagtggagcccaagactgaggaaggtcattttgagaaggcaggaccaagcctaagtgacaggctttttgactatgtcctggaaacagacccagaaatagtcctgtcttcctgtggactctatggcttcatttggcattgatgcttccaccagtgcatgccactaaggggactgagacaagtcacacccattgtacctcagataacagaaggtcctgactgtggaccctgaggtggcccagtaatttggcttcaggtccaggaacagtcctgcctgtccagggagccccaaggggatctgactgcagatcctgaagcagccccctgtgattcagtattagccccttttagtcatggtccagggtcaatgctgcctgcccaggaaccttcccagtgaattggcaggaaccctcccagggatctggcagtagccacactatctgtacatgtgataacaggccggctatctgtgggctcaactgcacaccctgaagtgtgccaatcaagtgttacatatcatttctactgaccaaggtgcaaaaggcaggctggtccttccagaaataagacataattgacactcacccaagcccctggtcacaaccacagacccctctgcctgccctgcgatagccacataattagctgtaaccctatttgactacaatccctgcagtaatcccatcagcccagacactcaacatgagaaggcctttacttgccaaaagcaagctataaaatctggaagatgtgttatctcctccaaatgcaaaattgaaacaccaatgcaaggctacatggatcacaaagaaattggcaaaactgacactaccaaagaaaacaaagacccagtaaccaaccctaaagaaataaagatgtatgaatcgactaagaaataattcaaaataatcatcctacagaagctgagtgcaacacaagagacacagataaaaacaactaaaccaaatctagaaaacaatgaatgaacaaaatgagaaaattaataatgaaacagaaaccatagaaaggaaataaacagaaatctgtgagagggagaataccatgccagaactaaaaacatttaatggtgaacttcgacagcagactttaacatgctaaagaatgaatacacaaactcaaagacaggtcattgaaaatacccagttagagtaacaaaaagaaaaaaaaattaaaagcagtgaagaaagcacataggacctttgggatatcctcaaacaaatatatacattatgaaagttaaagaaagagaagagggagataaaggtaaggaaagcttattaaaaagaaaataataatggctgaaaacttctcaaatcttgaaaggaatagacacatccagatttttgaagctcaaaggactgcaagcaacattatcccaggacacattataatcaaattgtcaaaagacaaagaggaaattttgaaagcagcgagagcaaagcaattcattacacacaagggaacacccttaagtctacgagtggatttctctatagaaaccttgtaggtcaggagggactgagacgatattttcacagtgctgaaagaagagaaaatgcccgccaataataatgttggctttttgtataaaattgtgtttcagatctgaaggaaagataagtccattccctgaaaaacaaaaactaaggaagtttatcatcactagggctaccttacaaaaaacattaaaaggcagtcttcaaattgaatgaaaccaacaaatgctaaatgataacataaaaatatatgagagtataaaattcattggtaaagttaaatatgtagttaaattcagaatactttaatagcataatggtgggtcttatttttaaatccagtaaaaaacattaaaggcaaaattattaaaaataatagctacatgtgacactctgcatgtgtccccaaaacttcatatgttaaaatttaatcatctatgtgatagtgttaacaagctggactttttaggatagctctgccctcatgaatgaaattatggccgttataaaaagaggctgaagaaatgtgtgccccgttaaacatgtgagcacatatagaaggcaccatctatgagcaacaggccctcaccagacaccaaatatgctaccatcttaatcttgaaattcctagcctccataactgtgagcaataaatttctgttgcttataacttatcctgtgtaaggtattttgttatagcagcccaaagagactaagacactataataatttgttaatggagtctcttagtccatttgggctactatagcagaatattatcccatactgggtaatttatgaagaatagaaatttattgttcacagttttggagtctggaaagcccaagattgagattcctgcatttagtgaaggctgctctccactttcaggatagcatgttgtgtgtcctctggaggtgaggaacactgtttgctcacaaggcagaaggcagaagggcaaaaaggtgcaaactgactctgtaactctgtcaagttattttttacaagagcgcctaatccctaattcctcaatctcctaccaaagtccacaactcccgatactgacacatcaaggattgaattgcaacataaattttagaaggcaaaaaaaaaaaaaaccctcaagtaatagtattctgtcactgcccccacccccaaaactaattttcttctcacatacaaaatacattaattccatccaaatagccccaagtcttcactcattccagcactaaatttaaagtctattgtctcatctaaatcatatatgagtgaaactcaaggcacaatacatcctgaggcaaatttcccttcagctgcgagactgtgaaatcaaacaagtgcttccaaaatacaatggtgggacaggcagagggtaggcagtcccattccaaatgagaaatgggtaagaagaaaggaataataaattcctataagtccacaccgagcagggcaaacaatattaagccttgaagcttgagaatagccttgactacatctcaccttccagacacaactgggcagggattgggaccccaaagcccagggtagccttgtccctatagcttttctaggctcagcctataatgctcttattgtttggagctggatcgctgaagctctaccaggctgtcatggcatagcatgctggaggctttgaagttctggagtttcatgggcagctgtgtacccacaactccagtaagcactgttctagtgaaagctatctgtgaaagctccacccctgtgacagggttctgcagtggttccaaaactctccaagaaatcctttgggaacgtagctggaggaagccatgactccacaatttgtgcagtttatatgtctgcagaattagcaccatgtacaccaaggcttaccacctgttctcactggagcagcagcttgagcctcaccttagccacttgagtcacaactgaggtggccaaggagtgctgaattggaatgcaggaagcagagacctaaagcagcctcgagcagtcagacctggggtctcacaaaacagtcagaaaacaacaaaatggaaatagtaagtactcaccaatcaacaattaaatgtaaatggattaaattctcaatcaaaagttacaaagtggctgaatggataaaaagccaagatacaacaatattcttcctacaaaagactcactttagctttaagaacatacatagagtaaaagtgaggggatggaaaaaatattccctgcaaatgataaccaaaagagaccagtggtggctgcatttaaaacaattaaacctttaatcaaaaacttgtcacaaagacaaataaggtcactatataataaaggggtcattgtatccaccaagaggatacaatgatatacacacggaatggatacaatgatacacacacacacccacgcacacgcacacacacacatagacacacacacatagacacacacatattcaacactgaagcacctaaataaataaagcaaatactaatagaactgaagggagaaatagataacaacataagaatagtagggaacttccataccccactttccaacaacagataaatcatctagacagaaaatcaatgaggagatatggatgcaaataacattatagaccaaatggacctagaatacaggtacagaatattccatccaaaagcagatgaatatgcattcttctcaaaaacacataaatattctccaagatagattatatgttggaccataaaactggtctaacaaatttaagaaaattgaaatcatttcaagtatatttttcaaccacaaaggaatgaaactagaaatcaatagcaggatgaaaattggaaaatttacaaatatgtagagattaaaaactaaaccccttagcaacaaattcatcctaaaagaaatcaaagaggaaatctaaaagtacctcaagacaaataaaattggaattacaacataccaaaacttacaggatgcaacaaaagcagttctgagatggcagcttttagtgataaatatctactttatgaaaaaagaagaatctcaagctcacaacctaacttaacacctcagagaactggaaaaagaagaggagactaagcccaaaattagcagaaggaaggaaataataaagataagagcataaataaataaagacttgaaaggcaatagaaattatcaaaacagagttttctttttaaagataaacaaaattgacaaaactttatattgactaaccaagaaaaaaagagagcactcagataaataaaaatgtaaatgaaagaagcatttaaaactgataccacagaaataaagcatcataaaactatgagcaatcatatgcaaataaattggataaactagaatagatagacaaatttctagaagcataccacttactaagaataagtaatgaagaaatagaaaacatgaacagactaataattagtaagtatatcaataatcaaaaactttccaataaagaaaagcccaggacaagatagtgtcactggtgaattctaccaagcattaaaggagaactaatgccaatccttctcaaacttctcaaaccacacatagaattacagaaagtatttttctatgaacaaaatagtatgcaaagtcagacacatatgccttaagttctacagctatctccaagttcttctttcctccaggtttctgtaccattagatttttacaaaatttacaaataaagtcaatatctctagacaacaagagtaatttggaagtaaacaaaccagatgggatttaaatggaccccatctcataaaatcagaatgcacttctttctgaaaagtattcacaatataaacaattgttaagcaaaccagagaagaaataactgctagtagacagagaatgtaaaatggtagacaagtccatatcttcttaaatgagattgtataggatagaatctgggctctataattgaataactgaaattttgaacaagtttaactccttgagtctctattttctctaaaatgagaaaccatctaagattatgttcagaattaaataggtttatgtacataaatctgttagaacagtatctggctggaataagcattatgcaatgtttccttgtggtggtagtagtggcagtacttgttatagtagtaatatattgagtatgaggattacagttagccatccatacacagactcaaagccttgctcttctgtatactagtgtgaactcctcagaacattatagatccatttttaattttttaatttttttatataacaataatcatatctattgatactttgaaatgattaaatgagaaaataattataaatgcttggcatagagaaacctctaaatactgtttaccataatcatcaccattataattattattaattaacaagaacttgatgcctcaactaaaagacataattttcatctaaaatattagaaattagagaattaaaccaggatattgcaaagaatcacaaaataatttaatgtacttttctttaagaacagaaactgtattggtagaatattttctactgtcatgttgagaaaaacaaaataaattcaattttggctaatgaacttgaaaagtaaaatacacattatatgacacagtatctttaaaattttttaaatatttcttaattctgtgcaaaaaagcagaaacccatggacttgactgtctattcaaattcctgtgctgcagaggacttatgttactgaaagaattcaacctcagtagctgactttatctctaattcacaagaaattttattaggatcatggtacaatgtaaagaggattgtattgtaattagtaaccctgagttttagtattattttgtttttttttttttattgctgatctaaacttgagcaatttaactcttttaaactccagtttcctagtctaaaataacagtacctatgccataagcctgcatggaaaagaatagtatgatgacataagaaaaaataatgacagaagaaaactattatggtcgttattcagaatatatgcatttaggtatgcattcattcgctcatccattcaacccacactttaaggccttatttacaataaatttggaatcgcttatagaaattaaaactaaatatttttagttttacattaaattgggggaaatagaaatgtagatcagaaatataggttgagttggggagagatgaacaatacacaactgaagaagtcttaagagcttacataaatcgtgtagctgagtcatatattttactctgtttcctgaaagtcaaagtaaaaaagggaagcgtatttagctacatggttctaattagtcattccaaacaactgtgttattttcttttcttgcagttgctctaaaatcattttacttttttacagggcccatcaaaaaaggggtaggcacttagctacataggagataatgagcaatgggtcatcacctgacaggatacagcaggaaaacattttgtagtaactcttccagaaatctaccatctcactaaaatgcaaactattgaatgaagttatacaaggctccaaaactagatggcccaacattttccttttcactgatatagcttgatccaataactcatagattatctagagagatagaggatctacatgtttttaatataactccccacaactatcacctttccagtgaggctttcagtaacagttggactacagacactttgacgtgtactacctgagatgggcattaatgcctggagtacaaaaagtctgatttgttgtgtttggccaaattcagatgctgtagagttcaaaaagatatataggagtttagaaaatgctacaagattcctaatatgattatatataccttaaaataagtggcttaaaaacaggggataattttataacctacaaacaatataagcatcaaatttatccatgccttggaagtgtcatctactaggaaaccagagttcttacgatacagttgattacttgagagactgagtgaaaattatatgtgtgtatatatatatatatatatatgtgtgtatatatacacacacacacatatatacacacacattaccaataaatcactcaacaaagggatgtattattcttaaataataactattacttttctcttgattcctgtgccttcattaccttgccatgatcaaatactgcttcttgccctacaattgaaaataaaagagaacatctggtgatttagagaaaaaaaaatactgaagaagaacaaatgggaaaggcaagttagatttctgcttctcctatacgtatctgtatgactttggataagccgattacttgaattttactttcttcataaaaaattaggactttggattatattataccccaatttttttctagatttaacattccatgagttactaatcttttgaagagttaacataggttcacgagtaaggctgaggacaaaaggatgaagatatatttagaaggcatgatttgaaaacagagcatttaaaagacttactaaaaatcttagcaaagaagacagtttgagttttaaaaacattgtatggatgcaataatgaaattataagtaaacatcaaaatcatatccaagaattatgatatttataacctgatttatgtttaatgtcagtttaagacagctatttcaattgttttgaatgtagtgtttgatgaggtcaaggctgagttcagtctaaacaaaatccagttagttagttccaaaactagtaagtagatactcttgatttaagggcagccactgtggaagccacagcaggtactggacaaagtgtgaagaaaccaaggcaagttatttcaagtcaaaacaagtcagtctgtgactatgaatgccttcatgctagtgatattactgcctgtacattaaggaatatttaaggtataattaatatataatcaacatagaaaagactatgatagtttgcaaggacgtaatttcatatggaatatttgggcaaaacatactttgtgacagattgcaaaaaaaaaaaaaaaaaaaggccacaaattcttcccatttttaatgcatcccctttgcaatgtgacttagttgctcttccttataaagctgtggcatctttccctctacctttctatctgggcttgattatctgatttaggtttgcacattagcaaatctgaaattagagacttaaaaaggacctgtgcatcgaggcttgttccctgttgctgttttgggaccccagagccagaagatgaagaaccaatgctggcctggtagtgctgaagacatgtgcctggtttctctcattgccccaggcaaccacaactcatatcagtgaagtccttcagagcaggaccaaggagcacccagacaatcaagaataaagaatagaggaatcaaggacaagcacttaatatggcacaggctagatgagcagataatctgagaattgtaaaaacaaacacgctctattaaaatgtgtattaatcatcttaattcaattatgacttcattagtagcatatcttttaccaaagaaaaagaaagagttattgtacagactaagtaatcagcaaattaatcttaatgttttgttgtaattttggccacttaggcaagtcatttaatattcaaagcctcacctgctaacttatctcctggccacaaatcttgaccttgaaatcagaatctacaaagactaccagaaaggtccacttacaattaaatccgatcatgatcatcctcaggttaaaaaaaaagtctggttccttattgttgacaatataggtatgaatttttggttttagccttaacaagctttgattaggtaaaatattagttgccaatataaatgaaaaacaacaagcagaaactgagctgctgtatttgaataagaggtggggctagaaggcaactattttgttgatatctttggagaggttacaaaaggcatgatttgaacaaaaagaaaaggcaataaattaaatttcaagatctttaacatgccagtaggttttaagctcctctacagcctcatctctagcaactttttgtcttgcattttacatttcagtaatgccaaactacttgtagctcctgaaaggtagcatgtcacttcagacctccatttctctgcctttgctgtattgattcatccaactgaataatctttctctgttttagagtagttcctatttgttttttaaggtcaactttaggtgtattctcctaagaatctttccctaactctagatggcttacatgaatccctataaatctgagccagacctatgctttcaagttacctttttacatatatatccttaagagcaagggcgtgtgctaccgattcctagtctgtggaagattttatgtgatacataaatgtctgagactacaactctgagttagagcaaggcaagtattttaagtcaataaagtgacctgagaagtttggcggaataaaaattttatcacaaaatatctactgtccctgcttttgccaacctatcatttttaaaagtgcatgtatcttagagatgtattcttttaataaccaaatttattggtctataagggtccattgtgccactggaaggaggaataatttaaatattccttgatattttaatttgttttcatttaccagatctttctgaaaatattaaaataaagctggaatgacataaatagatgggagagggaattaaatggctgtgaggagaaaagtatatattccaaagatgaacaaatattatttgatattaacattcatttagaaataatctactggttatgcaatatatatcagaatgactataaaatggttaaatagttgaattttgcatacttgcaagcacaggtgactcaaatttatgttacacagacaatatcatggtaactatgtttcagcctgtgggatggagaagggaattttagaatttatgattcttgcaacagggagaatattataaaatccccccatatgtggccaagaacatagaatgtatgttcaagggcaccaaatgtaggatgtatgttcagagtatgctcaaatatttttcagttatataagagaaggagccgactttttttttctttctttctttttctagacagtctgactttgtcgtccaggctggagtgcagtggcacgatctcagctcactgcaatctttacttcctgggttcaaggggttattgtgcctcagcctccaggagctgggattacgggcactaccacgcctggataatttttgtatttttagcagagatgcagtttcaccatgttggccaagctgttctcaagcttctgacctcaagtgatctgcgtgcctcagcctcccaaagtgctgggattacagacgtgagccatggtgcccggccaaagctgacattttcaaagtacattttgaagaaagtagacttcactggtaaattaattctccgttaaatgaagacttggaattattgcagaatacagttttaagtagaaacaggaaccttgattgacatactgaactaattctccaactgcaaactgctatgatactggagtatcctgaaataaaatgaagagataccgcagaatttggataatacaattgtaatataaatctggaatgtattgaaacaaaatcagttctcctagctacatttaccaagggtttttaccaatttcttataaagaaaagtaggaaatttaaattttattgcattacatcatacatatatatggagtaatacaagaaaatgtatatgagtacatatgcgtgtgtgcgtgtgtgtgtgtatgtgtatatattgttttatatatgtacacacacacacacatacacatacatattttttgttttgttttgagacagggtctcactctgtcacccaggctggaatgctgtggcacgatcttggatcaccacaaactccgcttcccaggctcaaggattctcccacctcagcctcccaagtggctgggatcacaggcgcacatcaccacacctcgctaattttttttgtatttttggtagagacggggtttcgccatgttggccaggctggtcttgaactcctggcctcaagcaatcctcccacctcggcctcccaaagtgctgagattacaggcgtcagcaactgcacctggccatcttatatttatagatttctattaattgaatattgacctttatgcagttgtcattcaatattcctcatccacttattctctatcaattcctttgttgtttctataatgtcctaaattaaggaagctttttaatagagagcagtggttctctgattgcatgttggcatcagctggggagggtttaaaaattaccaatgcccgtgccagaattctaatttaattcatctggggtggggactatacagctgatatatttttgtaaatgctcccagtgatggtaatgtgtatacatggttccactgttataaaggtattctcggacaagaaagccttaatacgagtcttagagtaaacagaacacaaaaaattatagcattaggccttaaagtgtcttatttttatccatatgctttttaagtttcagttatgtttgataacttccaagacattaaatctttggttatatatagaacacctcagattcaactagctatgtttcttctacaacagagattgtacatgagccaggatgagacaaagaaaatttgtcattaaagagtttagtaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgagacaggagaatggcgtgaacctgggaggcggagcttgcagtgagtcgagatcgcgccactgcactccagcctgggcgacagagcgagactccgtctcaaaaaaaaaaaaaaaaaaaaaagagtttagtatttacaggaaaaacaacagagctaaattatattagtggggagggtaaaaataaagattttcacggaatcagttctcacttgaataacaagagaggcaggatattggaatggagggttaaaatatatggaagaatctaagtaacataacaatgataagaaaacgagacgattaataaatatcagaacaaattcaaccttaatcacaaacatacttaaagttcactgtaatgcagagttaggtgtagcttaatgtctgatttaataccgcagatgtaaatctcaggctcacagaaaacacagatgattctccttgaaaaacccactggactttcttgtacctctttaaaaattaacattccaattgtagatctaaaataatctatgtgttagaacatgttagatattcatgtttatttaaacttcaagacttccacatggtggcagtaagtagctgttctgttcaagggaaagaactggcacctgctctgtatctccatgcactgaaaatctctactataatgtgctagggaattctgaatcattgtaaaaaaacccatctttaagttgccctctgagacccatgtattggaacacacatgttacaactccgatgatatggcaagaccaagaacatctggcatccacactgaggaaagacatcaagactcgtgggctttctggctctgccaacctttccagtagtgttacttgcaaattccatgaatagcacagtacaataattacagtgccttgccttatctttatgcctcttgttttctccaggtcaagaacatcttttattcctttcttcacataactaaattctgctcttcatttaggatgactgcaaggaatctattaatatttctttctcttttgatggcaaaaactgcaattacttttgcatcaatctaatatttcagtcaggtattcttcatatgactgtccacctgatcatacacttaacactaccctaattctttttacccaatattttaataattttattctctgttatactacactagattgactaagatccttcatctcagaaatgtctcatcacccatcacagttttgactcaaaactgcccaatttaccagacttaatttacatttggttttccctataatatagtttaacagcatacaacgattgctttcattatgacatttctaacaattataattttatgatttttatgtcatcacttctttactgtctctctacaggcagaatctagcctttgttatggggaacaccatatctgttttattctttgttctattattaacccctatcacagtttctaaaacatagtaaacataagtttgctatatttcagacatttacttttgaaaaataattcaatgaatgaataaataagaaaatatgaattaagggatcaataggcaatataaagttgaaatgattatctgacaattcaataaaataattataaactacttcaagtaattgataaggtttatttcagaatcagctagaccattcttttctgcctcttacactttaattatcttttattaagtacatccatcatgattttcttggatccctagggaatttacaagtccctgaagatcgtgcctatttttagtgaaatacaagtgatcaacagtttgtttaattagttttgtctgggcctgatcctatcatatctaaaattcagttcactgccttcaacaaaaggttacttaaacatgaaaatagataaattgacagtcattttatgtagatatctacattcttatcttcacttggataagcagaatacatatgctacatttcttgatgctatgaattgcatgtttgtgtcatcttcaaaattcaaatttaaacttaatccccagtgcaacgtgttaagatatggtggatttaggaggtgattaggttatgagggctcaactttcatggatgggattagcactcttacaaacaggcttgagagaatgagttcaggcccttctgcccctctgccttctaccatgtgaggacatagcatatttcccttctgccatgtgaggacacagctaaaaggcacccttttgcaaggcacaaggcctcccagctgaaaggccttcaccagaaactgaatctgccagaactgtgaccatggactttcatccttcaaaactcatagtttctgttgtttataagctacccagtctcaagtatttcgtatggttgtataaacagactaagacagaaattagtactgagaagtggtgtgtttctcgggctggggtagctatctcaggctggcgttgctagaggagaaaaaaaaaaaaagagagagagagggagagagagaagtggcatgcttctgtaacaaataccatttggaagtgactctggaactgggtaatggatagaggctgtaccctaaagtgctattctggtgacggcttagaagagaaggagaagtgtagagaaagcttgaatcttcatagagattacttaagtggtcatgattataatgttggtagaaatatggacatgagagctagttctggtaaggtctacagtggaaatgaaaaacaatgtattagaaactgaaagaaaggctacccttgttataaaatggcaaggaattcagctgaattatgtctgtgtcctagtgctttgtggaagacagaacctgcagcaatgagctaggatatttgatggaagaaatatctaagcaaaatgtggaaggagctgcatggctaatcttggctgcttatagcaaaatgtagcaagagagaaataatttaaagatggaatttataattaaaaaaaaaagttaaagatttgaagaagtatcagcctgtccagattgtaaaaaattaaaaagtgtgttagggagaagacactaacggtgtggccaagtgaacatttgataatgacattagtatgaatagaaggaagccagatactatttagtaagacaatgaaagaatgaccctaaaggcatttcagatatctttgaggctgtcattctcatcacagacccagagtgccaggcccttgagggcaggatggttttatgagagaggctcatgttgcccatgggacctcagaggtcactgcctagcatcgcctcaaggttctgctccatacattctggcacagcactccttggcctctccagctgtagcttagatggccccaggtggtaaaccttggagacgtccatgtgctgctaactctgcatgcacacagagtgtatgaactatgaaagcatggctgcctccaccttgattttaaaagatgccttgaagagccttggggaccaggcagacaaatgccacagaaagctcccagtaaggtgacaccatggggctaagaccactgaagagggtctccacaagagaaaagccttttggagatgtgcaggtgaggctacctcaaagaacccacaattatagagccaccagcatgcaatgccagcctagaagagcccacatctacccaactccaatccatgagagcggctgttgtgctatgcttagaaaagcagtgaaggtaaccccccaacaaccccatggccttggggactcaacccctaccccaacatattcagggagtgggatatggatttaaagaagattatttttaagcctgaagatttaatgttatttgccttgtttggttttgaacttacttggaacctgtttctcctttctttcttatttttccctttagaataggaatgcttatcctatgcctatctcacactgtatttgggaagcacaaaacttacttataggttcacaactggggaagaatttgcctcaggataaatcatacattgagactcacctgtatcagatttagatgatatttagatgagattttaatttttttagctgatgctgtaaagagttaagatttgggggactattacaatgaaatgtatatattctgtatgtgagaaagacatgaatttgaggggccatgggcagaaaatgtactgagtcagatgaaggaaagttaggaggaatttggaaggaatgtgagtgatggtgacatagctatgacagcattctctcccacttccaccctgctgaaaagtataataatcagactcagttcaaaagaaattgtgagaaaccaacattgcaattcctagacaacaagtcatctgattaggggttggggggaaggtttgaaggagcaagttgagaactttcaaactctgatatcatgagccagatgatccctagaacagcctagagaaaggaaagaagaaagcaagtaagagggctagcatatacatagggcttccacacagatgaaagaacacagatttgcaattggaaaaacttcaaatttcactgttttattgtttgtgcaagtttagaaaaaaaaaatcctccaggtcccaactttctctttgataatctaagaataatagcattacccagtgtttttgtgaatatagtatgaacgtagcgggactttgatcaaagtattccatttcctttctcttccatataaggtaaaagccatagctttgagtttgttagtattcactccaaaactgaactgaatatacagactacattagttttccataattacctgtgactgactttcattgagaaagcatatttactagatgtttaaatagtaagtagattctttggcagcctggtgggatcttgtatgagtgctggcaataataacatatgcctatttctctcaaagcatattgatggtgttttaaaataccaggaatctattgttgtaacacctcaactgaatattgcaacaggttaggcttttcactgagaacttatcctgagcacatgcattacctatttcggaaacaaagaaacctgtgatgctgcattccatatcacagttgttgatatacagcttcttacacaaagtgctctagatggaagccaattgaggttaagaatgtaggacactcaacgtaatctgtagaaaagaagcttttacaataaaggcagagtagctgatcttaacactaaaaaaagatggaaagaataatgaaggacaaagtgagaaggcagaattcaatacaccctctccactctaacagagaaagcagctacagtaaaatacttccatgtctggtactttaaacttaatacaatattttttctcagtttacaaaatatttcttataacttacatattcttcaacaaatcagaatgatctcaaaatgaaataagttgtttaagagggaatatagcagcaaccaaactattaaactaccttgtaagcctgtattttgtggtgataatcatattaaaattccaaggatttgctggggaattaatgtttaaatgtttttaaaagtaagcccccattcctggttatacattccatctctatagctctgagtttcttagacatcctacaacttagtaacacaggtgattctaatgtaaagtcaactcttggacatctctgatttagtttgttttatcattttcaattatcatagaggaaacatttggaaaaaataattaaattgattagagaatagaagtctcaggctattgttcatgtccttggaagtaaacttgagtatatagggctagctgtgggaaactatgtaggcaacaagtcaaattaaaatcatgtgattggagaatgggaggaagtctgaagtcaaatttgcactctttagaattttgcccacaatatattgtaagacaaacaacaacaacaaaacaacaataggcaaatgagaaaactcaagttatttaagctcaaatatacaaatgccacttacatgaacacgtgaatcatttcacggttttacgtcctgatatttccacttgcattcactcttcctatatctatggttactgccatatttcagacccatgatacattttacctgtgctgctgaagtattcaaattgattctcattgttttcattctccccatctctattctattctccacagtgaatccaaaatgactgttcccatacatccaatctgccatcttcaaattcctatgcctatcatacgactatgtgttctgacctctgcttatctcttgactatgcctcttgtcatagtcacatgtacactccacacttactgaatatgtacagttttcagaacacacctgatgtagattatgtttttaaccccagtgccgccacattcatgctacttcctctttcgggcctttcgctaccatctgtaccttccctacctatggtctagtttacctttatttttatgaatggaagcagctataagatacccagagagtttaggagagtcttgttgtaataaaggtattcactgagttctatttgctcaaggaaaagcacactttagagatgctctttttgagtcattatggtatcaagttggtattgttattgcatgaatcaatgaagaatagtctgataatggaaacactcaatggggatatttgcataaatgctctgttttgttatattgatgtgaaaaattctgatcctctttcattaaggtgatttttgtagagcattgtgaatcacacacgcacacacacacacacacacacacacacacacacacaaatccatttccatctacattcaaattttactgcatctcaagagcctaggaaattttagtgtgggaaaagagctgtagagaaccagagctagtagctgttgcaattacaaaatgatcagaacatgtctacattatcaatctaacttaccctctgccactccattttggggttaaaatagaatttaaagagtctgaatattttgacatgatagagggttaatctttcaggaaataaaatttgaaaacctgttcaatgtcttcacgatgtcatagaaacacagaataaaagaagcaacatatttgtagggtagatgcttagttttgaacactaacttcaaatcagacacttagaagttatacgatattttaacaaacaatttaatttccctgaactttattttctgcatctgtatgtaataaaatttacttcaccaagttagctagaaagtcaatgagagagcataaaggaatgcattttgtatactataaaactgaagagattgcacattaatcactaagagattatgttaatataaaattcataattatcacacattgtaagataattttataattaatatgaccatgaccaattattatcatattctgggctgtgattcttgcattttcaatcacgaaaaatcaattacgataatatcaaaaattattgtggataaactcctgtaatatcattgataaagaaaaagcataatggcagacagtattaggatagtgcaaacataactgtggttttttgcattgttgagatttgctgtttgatattggaatacattcttaaatgaatgtaggttatacatcatttaactgttcatttctcaatttataattttttttgctaatgacttcttgttatttattttatatttatttagactatggaaatgatgttagacaaaaagcaaatttgagcaattttgttattcgggttcaaaatgggtcgtaaagcagcagagacaactctcaaaacatcagcaacacatttggcgcgggaactgctaatgaacgtacagtggagtggtggttcaagaagttttgcgaaggaaacgagaggcttgaagacgaagagtgtagtggccagccattggaagtagacaacgacaaattgagagcaatcattgaagctgatcctcttacaactacaggagaagttgccaaggaactcaccatcaatcattctatagtagtttggcatttgaagcagatcggaaaggtgaaaaagcttgataagtgaatgcctcatgaacagagcaaaaattttaaaacattgttgttttgaagtgacgtcttctcttattttacacaacaatgaaccatttctggatcgaattatgacatgtgatgaaaagtggattttatatgacaagctgcaaaaaccagctcagtggttggatggagaagaagcttcaaagcacttcccaaagctgaacttgcaccaacaaaagctcatggtcacaatttggtggtctgccgccagcctgatctactacagctttcggaatcccagcgaaaccattatgtctgagaaatatgctcagcaaatcgatgagatgtgccaaaaacttcaaggcctgcagccggcattggtcaaccaaaaggatccaattcttctctaccacaacgcctgaccacatgtcacataaccaacccttcaaaagttgaataaattggtctacaaaattgccttatctgccatattcacctgacctctcaccaaccaactaccacttcttcaggtatttcgacaattttttgcagggaaattgtttctacaaccagcaggatgcagaaaatgctttccaagagttcactgaatcccaaaacatggatttttatgccatgggagtaagcaaacttatttcttgttggcaaaaatgtgttgattgtaatggtgtctattttgattaatatagatgtgtttgagcctagctataacaatttaaaattcacaatccaaaaccacaattatttttgtatcaacctaatactatagatttaacaatattaaattacaaagccttttaattcaaaataacaggcatatgtcttttgggtgaacagtaaaacagtatatatatatatatatatatatatatatatatatatatatatatatacacacacacacacacatatataaaacatatatactgaccatacgtatacacacgtgtgagtgtgtgtttgtgtaaactccatgcttgatggacggatggaatagatctgtgagcaacaaaaccacagttactcaggaattcttgacttaaaagtcagcagcatcagtgctagatgaatgccatatatacatgaatagaatccaaaaacctatcagcctaactccaaattttaataacttcctcagtgtcctcccagcacttagtaatagggccagtattgtttaaatactatcattttttcatcgattatttaagtttcttgtctgttcacagatacagtatttgaagattccaaattcctcaataaaattaaattgtttattttcattagcaaagcaaagttctgacaaaatatttgatgccttatttgaggtgttaggaaaacgactggaattagatcaatggtgttttttataaagcaaaacctgctataaatatagattagatttgcaaccagatttcattaacttatcaaaggagcagtgggtcagcaatttcgagacattttccttcagaactcttgtcacattccagaatttctcagaatgattttggtatttatatgggaatttcgaaagaaacttcaaaagaaagtatgtgactaattctacatgcctgcattttgttacctaaattctggagagggacatgtaatgtcagatgacgacatctctaccctccttgccacctaggtacaaaacctcagtcatccctatacattcttctctttcttacttttcaaccacttgacatctaagtatatatgtatggttgttatccctaaaataatagccaaagttgtcctgcattgaatttgtaaaccaatctgagaataactgaaatctttataaagtcttccaatccatgaagatgatttattcctccatatatttgagttcttttaaatatcattcataaagtttgttgttttacaggtttattccatggtacttggtattttattttgcacatttttgtgatgctgctatattttgcctgcaactaaccaatggaaattacttaaaatccttcaccaaacctttcacttaggcattgatagcacccatcagatggacaaattattatttgttggaccaggccttttcaaaactatcaagcagatagtcaggtcctgtgaagtgtgccaaagaaataatcccctgtatgcaggccatacatttcaatctctgtatctttaacctccttgttaagtttgtctcttccagaatcaaagctataaaactacaaatggttctccaaatggagccccagatgcagtccatgactaagatctactgcggacctctggaccggcctgctagcccagctcccacattaatgacatcaaaggcacccctcccgaggaaatctcaactgcatgacacctactacgccccaattcagcaggaagcagttagagtggtcgttggccaacctccccaacagcacttgggttttctgttgagatgggggactgagagacaggactagctggatttcctaggccaactaagaatccctaagcctagctgggaaggtgactacacccacctttaaccactaggcttgcaacttagctcacacccgaccaatcaggtagtaaagagagcttgctaaaatgctaattaggcaaaaacaggaggtaaagaaatagccagtcatctatcgcctgacagcacaaggggcgggacaatgatcaggatataaactcaggcattcaagccagcaatggctacccactttgggtcccctcccattttatgggagctctgttttcactctattaaatctttcaactaccaaaaaaaaaaaaaaagaaaagaaaaacaattaacttttttatatatcagttaaattcatccatgatgttttttatgttttctgtattcttactggtcatttttctatttgttctatcaagtatccaggaatatgtgttaaagatgtccacttcaattgtgaatttcttgagttgttctttcagttttgttctttttttaccttatgcattttgaagttgtattatttcctgcatacaaatgtagaattgtggtgtcattcttttggagtaaaccatgatcattactggcatgacttacttacttactatctatctagacatgttgattgcttcaatttctactttaatcttaataaaaatacaccaacttttt

SEQ ID NO: 1133 - DNA, 135962 bp, Homo sapiens
tttcccttcaactttgtttattgatgtactgaacatgaaaaagtacaaagaatccaaacacaaaagaaaacatgtacagcctcttaaatactcaacagaatatattttctattccaacagatgtgaattaagtcatactgtacaacttcaaataaataccagccttacattttattaagtgctctgataaaacactgtaaagtgaagcacaatttgcatgccctctcatcaatgccttggtttgctacagtagtataggaaagaagcatgtagctgctgttttcccttgagggaaaccttattatttttttttaagtatatacatgtattttattttttagtgtttttctttttttaaacgcagaaggttaactctggcaatctaaatgcacctaaggatatgagaaagtgctaagccaattgatttctgaatagcattgagtgggtcagcatgaaaactcgcttattcactttagcacgcgcctcacagtatatgtactgtactatactgaaaaattttataactacaattttaaataataaaaaataaaactcaaagcaaccgcaaagataatgtacaactatgttatgcatagcacattgcctgttctaaggggaagcatgtgagcatctcagtttatacaaaaagcaggacgtaactatatagttctcagtgcatcctgatgaaggcatttttgccttcagcttttttgaaaatttattataagctagatgctaatcagaaaatattttgtattttttaaaatttctttcatacatggtaaagacttattttattatttccccaaatagtggtttttaagcatcatacaaagttaaatttcaatagcatacagatatttatgatttttgtatgaaaaatgtaaggaaatttgttcaaaacctatggttatactcatttttttataccacaaacatatttataaaccaaaatgtagcatcaccataaacagctgaagctagactatctacagacaaaatttgcaacaaatctgatgcactgtaaattcaagtcctcaggacaacaaaagtgattaagcaagacctcaagtaacaatgttaatgccatttacaaaggaaaaaactgatacaaaaacattcaaaacctgaacatcacttggcatgtaagggaaaaaaaattaaattagctgaaaggttcataaacacaaggtcttatttacattacacaaagctcaggtgttagccttgaacgtaactttcaaaataccttcaaatatatccaactcagatcacttttgctgatttgctgcagtacaaatcatgtgcaacgtcttttttccttaagacaaaacaattcttcaaacaatactgcaagtacatcactaaacaccatgagctctatctgaagggatttctttaggaagaacagattttttcccccatctctcggtaatttaaatttcttgcctgctcttatatattcttttgtaaattttttttatttgtttcaaaatcacaaatcaatgtgagccacctatcacataataaccaggatgatcagacgctccactggtgattacaaaaatgaaaccagcagtgtttccccccattgattctactcctttcatacaaagatctcaaaagtattttctacaccataaatctttctaaattttccaaccgctgcaaatttcctggtaaattttaaaagctcactaggtgtcatatgaagagatttctcaaagtattcaagtcaaaatatttgttccaggaccagtaaaaagtttctccaaattttcttttttataaaaatagatgctttttttaaacccacatcaaagaggctcttatctctttggcaaggtactgctttacgaaaagttctccagtattcttacaataagcgtttataatgtagcccccccttccccaacccaaatcataattacaaaataaatactgttttaaacttcataaataaaaatgtaaacttcaaaatacttttcttaaacagacataacagcaatgctttaaatgtaaaccaaacacaaagctaatcagaaaaaggaaaaaaaggggggaaaaaaaagacacaaccaactgaagaattacaacacaaagcctcaatatttactcacaggttcaaggcagttatgtaaaaagaaaagaaatgtcttcccttagctgaaacactttaaaaggtccaccttcttcaaagaaggcaatagaatgcaatgtgacaggtaaaaaccctgtacctcttgtccatattcaaacataaaagatatttaagaagttttaattcaaatactagcaataaaaaatctcacatatttcttaggatgctaagtagtcattttatccccatctcaacactgacttacaaagacatttactaatgtataaagtttctcttaacttgcctttgttgtatagttttcatatataaatggactgaggacaagagctcattaggctttgtgcgttttgtttgtcttaaaggagacctgcagtactctgtctcccagacggtatccattgaggctagctatcgccatggcagcctcatcatagtttgtcatagtcacaaatccaaaacctttgcatttattggtgttaaagtcacggatgaccttcacattggtgacagctccaaaaggcccaaacatttgccacaggatactctcatctgcgtcaggagccaggttgtacacaaatatacaccaccctgttccagggtgcccagggatattaattccagccaaactggtcattccgtcaatggtcattggagaaaacctgctaaacagaataggaaatacacacatacacacaaaaaataaaaacagaggttggttatagcaatgaacgtataccttttccatccccaagaattttagtaactctcctcccccaacaaatatataaactatttcatgttttgaccaaggtctgtgtgtggctttgcagtgacatgctagactactgagatattaataagttatgaaatgaccattattcactgtactgaatatcatccacaatagcaaagaaatatatttagaactggcttcatgaattaagcaggattggcaggggaagggatcaacacatacgtaaacatgctgtaacgtcgtaacgcaatacgaaacaaatgatgggtttttaaaagaccaggtggcatccggtggtataaaaatttcttgagtcaattgtgcttcaaagagcagcttttcattaggttgcacatgcaaaataaaacccaacaaaaacttatgaggggtgtgaatagcactcccaaaatcaaagaaaccaatcaactgtggaaagggattatgagtatcatgaacctctatcattacctctttactccataagccatattgagcagattgtccaacctgcaaaacacacatttagcaaacttcagtttttaatttttccccttgatgttcaagaaagttgggctcattactgccatcttccgaggggatatctgtacactgattatatgtgaagactcagaatgctgggtctttttacgtttttaagctaatgggcaccgactgccacaggacagttcttccaatgaatggtttctctctacaagggtcagtacatgggacacagtgacggtcatctgaggatacctttcagagaggaagtgcgaaagctctgggatagttaactttagggttctcatcaggtagcttcaaagtgatcaatgtatagctacatgttctttatactacttttgattttcacaactctgttggtgcctgcagatacctaaggcacacagggtttaagtggcttgctcaagaccacagggctagtaaattatggcattgatactcaaactctgcaggttacagaattctatacattttcctttcatttcccaactttgaagggctttcatcttttagaatcaaggaggtataattacaggtagaaaaaaccttatggacaacccaagctaaccctcccatttctcaaatgtgctcagctgaggtctagagaaggaaaaaagaaaaatccatcactccagtgtgcaacaaagccaagagttcagatcctgatctggatgctgtattcaaattacgctacaggaagtgtcgtcctactcagttttcaaaggccaggtaggaaacaaaacaagccaatctgagcctcacttaaaatgtttatagaaagtaaataggggtgggggtggaggtgtaagtactctttaaaaccttctacatttttcctatatcaaatattagttttacagcatttgactcttctttatcagtttcaaaacaccactctaatgtcccaaatttccacagtgcttaccaactaattatgtgttctgaggaggaggcataacttaatacatagtccacaaccaccctcaactgctacaatgctcaacactctccaaagacatcccagggttgtccctctgggactgggggtgggggtgagaattttttctttaacacccgtgaaaggtaagtttgaaaagtctcagccttatcacctaacctgtggcatcaagtcacgctaaagtatacatgcaaaagccaacaccttttagttttgtaaaagccaaaacacatctcatctggtctttcagaatggggaaatatatagcctcccacatccctgccctcagtctccactgaaaattctgttttgtaaagatgagaagaactgagcttatgcaaagtgtaaggaaacagaacagatcacaatgacaaaagatcttcgtgtgtgagtgtgtctctgtgtgcgtggtgcgtgtgtgtgtgtgcgtgccttgacccaccaccctctcattgcaccactgagcacaagccagggtcactgatagtttataataaatatgtgatgaccaaataaagacaatgaggttaccaaaattatggtcaacttagtccagaatgaaaactagtaagaggattggttggatgaccttgtctgcacataagtaaaaagatgtggggttttattttttgcagaggtgagtacagtcaaagatgccatgcctttatagtcaagaataaggatcacaactaccagcaataaagacaaacacatattagcaccaccaatcataaagtaacaatacaattttatcaaattgctggaatgatcaacacagaatgcatttggcatatgctacctgtagaagagaaccgcatactgaggtctccaaccaaagtgctagaagacccagaatgcagaggcaccttatcaattcactcaaaagttacatcatctatgcccattaattgcatccatgtagggacaggtcatgctttgctaccacccactcaggacaccaagcatacggcccagagacagatgagttttcagaattttcaaacagggtagaaaccaaatctgcccctgaagtgaattaccgtcaggccttttttaacaatggggatatgttctgaaaatgtgtcactaggtgatctcgttgttgtacgatcatagaatgcacttatacaaacctagatggtaatagcctaccacacacctagttatatggtatgggctatggctcccagtctacaaacctgtataacatgtcactgtactgaatactgtaggtaattctaacacaatgctaagtattgtgtatttaaccatatctaaacatagaaaaggtaatgcattgcacaatattaggatgactatgatatcactagacaataggaattttttgcagtctactatattatggtaccacggtcgtacatgtgattaactgaaacgttatgtgatgcatgactgtacatgcagtgagggagaaacatttcgttttccatcctccatctccctcacttccatctctggcatccccagacaggaggtttcgaattttttataacaggatctccgaggaccctccaaattatgatagggcatcttttttaccctatctgtgaagttttacatgataccatgatcttcactgattccttcacttctctctcattttagaaaaaaattggtcctttggaactaagccaagttatccactctaatctttcttctcctccatcaccaacgagtgtagggagaagcatggaacctagaaaacagtgcccaggcactgctgaagccccctgactgtatgcatctgagcccagaagtatttcctagctttctcggtgccatagattcatgtttcccatgggagctcagaaaaggcaacgggtgctctacatgggcaccattcactccaaatccagtagcagttggcaaactgtaacacaggcagttgtaagagaaaatagtgcagcagctcaaacacaaggactactacaacaagcccctagaaatatgtctgctgggtctgtccactgctcaaggacatctttttattttatttatttatttttgagacgaagtctcgctctgtcacccaggctggagtgcagtggcgtgatctcggctcactgcaaactctgcctcccgggttcacaccattctctggccccagcctctcgagtagctgggactacaggcacccaaccaccacgtccggctaattttttttgtatttttagtagagacggggtttcaccatttagccatgatggtctcgatctcctgacctcgtgatccacccgccttggcctcccaaagtgctgggattacaggagtgagccaccacgcccagccatcttttatttatggtcatttataaatggaagtcaatttttaaatggagagcaagctagctgcctccagaatatctcagggaggggtgtggatgataacgtagtacatatggaaggtaaatattaaagtatccattaaatatatatttaaaataaaatataaaataaatatgtatttaaaataaagtattttttacttatatttaatagatgcactgaacccagtaccttctcagtcctgtgtatcacctgcctccctgggggaagactgagcaatcatcgaaggggagaggcggcgagtggcactctctcctgctctttagcctgaacaaaatccattttacaaataacacagcaagcagatatggaggattagactggataacctgctttaattaaaatgacctccatttaaagaaaaagtaacttaaaaaaagattactacaaatgtaaatcagagtaaagaatggtaccagtaagggaaatacaagtaaataaggaaagggagagccgattatttctcctactcttagtacaagctacattataaggttagacacaagataatccaacatgcatcacatgaagtcagatgagatatctgaaattattttatggtcttgctttaaaagacatttattaagatattaggtacatggaaaatgaagccaaccagtatagtaattagcaagacatttaatacagattgtctcatctttatccttttttatgtttgattagagtttataatttaatgaatagcacacgcccatgtacatatgtaatttatgaaaaaggcacataggagagagatgtgtataaacatttttctatcaacaggaccaaagctccaattataacctgtcaaaattttgaacagaaccatgtatcagatcattcctattttaaagctaggtgttcataagtagaaaataaaaataaagtacctgcctaatttctaaaaaaattagctgatggactatgggaaggcctacatgtaagtaaggggaaatgtgaacccgattaaagtcagaaataaaaataggaagataagttattgatgggtaagaaaatatactcggaatcccacaaataatgattatcaaaatctctccaaagcgccaaccgagaactgcttggaaattatctacaacaagatcatcttcttactgccttactgccttattcaattagatggtatcatctgtcctctaagaaagaggaaaagtattcaaggggattgataccggtttcttccaaaaggaaattgtgataatgcaaccagtacgtcatgccttaaaggcaactcaagtgctcatttaaaaggctttttaaaaaatgcataaaggctcatagaagcaggcacacaggtcattacactagatcatattcaataaaattatagctgtttcacagaaaagaacatgaaaaaatttggcttaaagtttaattctgatatcatgtcccaagaatatacttaaggggcttgaattacaccatccatccaaataaataaggcttgtcctattttgaaaactgcagtcaattaaataagcgtattagaccagcagtgctcatattacaacaattctctgattattcatagattgactaagccataaacctcacaaacccacctttaaacttaacccttattacatggatttttaagctttttgaccataaaagatatggctcatactttatgattattaaaagtattcttgaccataatacatataacttatattgctcaatctctctcaactcccaaggtactatgagaacataaaaatacagtgagaaattttctacatgtctgctgaaaggtgacaaaaactcaaggcaagagcattaaaacacaaatatcagggacaaaatatatctgtgtgatgatttagactcgaactacagaaaacagcaaaataccaacaaaacaagcaagcccttaattcaagtttctttatcaggtgaaagaagaagggggagtggggcggaaatcaagataatgacaaccaggttcaatatactgtattaaagaaaagcatcaaacatcaggttaaacctgaaatctgatttcttccaacacacccaatctagatcaaacactatctctgagcacactaactcgttcatattttattatctggacagggatcatgggaggaatgagaaatggggtgaatgggacaacagttaaaaatctgaagagagaataacaatttctcccattttctgaaaccaagtttcccttacaactgacaatctcttattctcttcttccaaaatgtctttctataggagtgaaggaaaaagaattttcaagttaatgataacatatggtactaaaagataaaaacacagaatgggccagaaaaagataattaaatttgaccataagaacatcctgtaaagctttactcaaccaaaaataaaaagcacagagcctgcagggatggaggctaggtaaacctaagggctgacacccatcaacaacctagcacctgagtcacctacaagccttgccatttcaataatcaggcactctcccaaatcctgtcttctcaatcttcctaagaattcaatcttgattccaagaactttgttttacttaataactatcaaacaaaatcattgcttcaatctggaaaaaaaaagtagctaatatagctttccactaacagcaaacattttataacttcacaatgttaaaaatcaaccaatacattatgaagaactttgttctatctaaactcgagatcattttcaaggccccaaagagctctgaaattaactggacaagctgcctaggaaatacctgtaaaattccttcaggcttgttcatcctacgtttgcaatttaaaaaagtatatttatacatatattattcacttaagatgtcacagaggaaacctatgtgcagagctgaaaaagggctttctttgtgagacttctttctccacaaaggcaagcatcaggcagccccacgcatctcccacactagtctgatcaccactaccatgggaagtcaaaggtggcaaaggttttttttttttttttttttttttttttttttttttttttaataccaatgccttttcctcacagcagagcatgaagtacaaggctcaatgcttttgacagtaccacctcttctcccacggcaaaggccaacttaagttgaaatttaatgtggcattcataacaaatttccttctcatatctcaagcaacataatttagtatttttttaaaaggagctatttttaactgattttatctccactctcttcagcactgcaaatattccaatgaaaaaaataaatgcatagatttaagctagaaaacataactcctgatcttattaggttatatttgtgattatatttttggtaattaactattctgtcccatgaatgaaataaataaaattgatatgcacttggaaataatttttaaaaatcagtgtggggttagatagcattctgggtatagtgtaccatatggccaaaaaggatatttaaaaatgtcctggaaaataaaaactgcatgacttgcttatgaaaccaaaaactctctgctctgcttaacttcttaaagtcactgttcttctcacatgcagattagagattttttgaatgactcctggtttgttatcccaggatcagaataaaacttaaacagttagcatatgtacacctgtcagtgagatagagtgtcttctttgggctaaagccacggtcattctatgaactacagagaggtcagtaaattacaaccgacaggccaaatggagactgcctcccacctgttgctgtatgggctataagctaagaatggcttttacatttttaacaggttgtttaaaaacaaaaacaagacagatgcaacagtgaccataacccataaagttaaatatttactatctggtactgtacagagaaagtctgccaacctgtttgtaaacaattttgaaaaggaagagaggaactcatttgtagaaacttcacgtagtcacataggttatatacccttaatggtgcacatactataaagtgaagtaacagaaacagcttgacctaaaaattgacacatgagaataaaatcctttaagaaaaaaaaaaaaggaaatctgaagccctggaaacaattcagataaccccagaaagctacagattagaatttctcaaccacagcattattggtgctttggaccaggtaacttctggttgctggggctatgctgtacactgtaggagcttagcagcatccccgacctctagcattacatgctagtagcacccccacaggttgtgccaacatgaatacctctagacattgccaaatgttccctgggaggcaaaaatcacccttggttaagaatcactgctgtaggttactgtcctttggtccccaccttcaatattagcaaaagacactattcctcaagtagattctctctgtgcccatggagatgaaaaattaatagtaataaaaccaacaacactgacaaaagcaaaccagagatcctgtcaataaaagtactggacagtaaacctgagtattctctttcagtttagtagctgggcacaagaaccaaaccagacttacctaaaacgctgtgcctgctgagctagcggtcctggataccttctgtttggagactggtacagctgggaaaggatggcctgattggttttttggcttgggttattagcaaactttacagtgattggctccgtggcaccgggaggtttctggccatttaggcctttgatagcttcttctgcctcaattcgcttgtcaaatcgaataaaccctacaccccttgatatgcctatggtagatttgagtaaagatttggaaaagagggaacagaaggagaagggaaggagagaagaaaggacacattaatttttccttctcaagaacatgttttcacctacatataacatttcccacaaaatcacaccaggaggaaactttcccctttacttactagccattcagtttagaatcacaattttgcatttttagaaaaattcgtgtcacttacataatctgagtacccattatcacatgcattccaatcagctaagacaagaaaacacaagcatgtccatgttttctctctctcccacctccctcccgtacactcttttaatgtcaatagtgtaccggagttccatttttcaatttgtgctattggataagcagctcagaaatgagggacacagtagttcctgtccttgaaacaaggagaacagaaagaagaatttgctaaaaatgctacaaagctatgctaaaaatacatacactgtggtagaaagacatttcggttgaaattttaaataatatattcagcttaataatattgcataggatataggtcctttaggaaaaaaatgcctgaaaatgctcttccagttctctgaagctctcttgtgcttctgactagctatattttattacagaaaaatattatatggagaaaaagaaaagacgtagattttaaaaataaataaatttctagaagtaaagcatcaaagctttctgacctcagcagcatcactcctgactacagaagatcactccctgccccacattctccccagtgtgaaagacacaaatgggaaaggatagccaagaacctttccaggttatgaaaaattgtagagggaaacccagcttattccatttaattagcgtgaacaggctagtggggtgaccacagctggtcatcatgagataagcagtggcagggaaattttttttggcaagtaaatgagcactggaccatcatacttggaggagcttaaaaaaaaaaaaagaaagaaggtctacttgctttaaaattaatactgtgtaaggtcaatgactaagaattttctaatgtagacaaagcattttttccacatatgcgtatctaagacagcccctatcactttaccttttctatttaaagagcatgcattgcacattattaccacctgatggctgaataagaaaattgcagggtttcatttttcatttcaggtaaattgagtaagttcactttgaaagccttaagtatgaagaataaatagtgaaatgatagcaaatcctttcacttatctactagcgcctattaagaattaataacctctagaatttagctgttccattagaaaagcatcagattagcaaaaaaaaaaaaaaaaaaaaaaaaaaaaaacagcctctacacagctagagtcacctaaatcggtggtcctcctacttaagcatacctaagaacaacctgtggctcaccctcagagatttattcagtaggttctgaatgaagcccaataatttgcatttttagcagggttccagaagactgctgatactgcaggtgcgggacatacttgagaaccgctgactaaaacaagctaggtccacctgtgatggactagcaggtaaaagatgagacgcactttgtgtcataggtgaaacctactctcaattcacaagatctcagaatgaatgaattagaaagcacaaatgaaataaaaaatatttttgttgctttgaacaaattcatctttatttctaggcctggatttctatttaacaccattattagtctatgtgataacaacacagggtggcaatgtataagtattatgaattaactaacacaattaaggaggctgtattttatatactctcacttgactaaatagtctcatgacagcaaaatctgtaggctattctcccaggcatgcatgtagtgctagctctctctactcagaactctaaaggtggtgcttcctatgaagccaattaacaacacagaggcaggtaatatgggctcctctgattagattcagatcaactaaatggatcttcacttgatgaatgaaaaatctggctcaattttcttctgaagtcactgctttaaaagaattagacattgtaatatacaacatgcctccaaggtattattattatacgggtggcggggagagaaacaaacagtgaggagaaaagctaccttaaaaaaacaaacaaaaacaacctcacaaatcttcatgtggctgcttcagtctatggtactacagctaatatttcctcctcacaatgtttctctattttttaactgtttcctaaagaacaagtattgctttcattttattttttacttattttttgaaatggagttttgctcttgttgcccattgcccaggctggagtgcaatggcatgatctcagctcaccgtgacctccgcctctggggttcaagtgattctcctgcctcagcctcctgagtacctgggattacaggcatgcgccatcacacccagctaattttgtatttttagtagagatggggcttctctatgttggtcacgctggtcttgaactcccagcctcaggtgatccgccctccttggcctcccaaagtgcttggattataggcatgagccactgtgcctggccaagtattgcttttataatagaaaattgtatctgtattttatttttaaaattcataatcaaatctatattgctatagctttgttaactaagatttggcagaacaactcccttacattcaagagttttaatgaacattttagtcttcccatttcagttgggctaacagtgatattaggaataaaataaatttttaacattcaaaatttcaaactcttacatatgcccatacagcacagcatgaacctggaaaacagcctgaacagcaattaccagtgtggatgtagtgtaatcctcccttggagaactagctgcataccgctgcattaaacttcgctttttgacaaaagaaaggttgtttattagtactctataagcaggatgggggcttttatcacacagtggcttggaaatgaagattatagcatctataaatttattacaagccatgaaacaggcttcaatcctgcaccttcagggtggaaatgactcaagcacgctcactatactccacaatctatttttatccatgcatatttatgaacaattccagcagaaaattgcattttctggcccacatatacctttgatatgttctagaagcaagactgctacatggaaagacagaatatttcacaatctgctagtcagagacagggaaagactgtccggagtggctgtctacttaccagtgacctggtcgacaagaatacgagaagtaataatgcgtccatattgtgaaaaaagctgttccaactccttctgggtcattgtttttggaagtccgctgacatataaatttgcatctctgatagaagctgaacttgggcgagcataggaaacctggaaaaggaaaataaaattaaatgtatatgcatgctcactcacccacctccctttagaaactcaaaaactgcctcggtaactttcccatgaacagcatagaacactgaagttcaagcaagtcaggtgctaactgctttattcatttccaggaaaattctagacaaatgggtagtagtattcccattccctctcccctaggtggacagggaagagtatctgtaatatgctggactagcctactgcaagggacagaaatttcacaatatatcccatcctccagattattactaaaaatggtcaatgggtctgggatcaatttgcggaggtatagtgattcaacaactgcctgctcattttatcatttgtacccacctttagtccagttttaattcactaaaatttaaagttcttaaaacagaccagtggtgcatacagcacagtactgttcacaataataggctgtcttctgtggggccaatcccctagagcagtggtccccaacctttttggtaccagggactggttttgtggaagacaatttttccatggaccatggtgggggatgcattagattctcataaaaactgcacaatctagattccttgcatgtgcagttcaaaatagggtttgtgccctgatgagaatctaatgctgcagctaatcggacaggaggtggagcttgggcaataatgctggctcacctgctgctcacctctggctgtgtgcactggttcctaacaggccacggactggtatgggtccatggccaggggttgggaacacctgctctagaatagggatttaggcccaatcattctaagcttaaagattccaaattcatggaacatttttgttttctagcctctcacatctgtgtgggtggtagtgctacatttctaaaaaaaaattcacccttatcagtaagtatgctcttttgatatatgctgtatgattgtccataaattcccagaaatttgaatgtgtgaacaagccctcattatcctttgtctgttgtcttctcatccacaggtctttttaaccttgattttcaaaaggtcttaagtccctataattaactttgcctgccactgtatgtactttcaaaaagtttcatgtctttgagatacggtataccaaatcccacaaggacgaaagacaaaataggtctgcatgtatttgtttataatcatcattcctcatgtaaactctgtgagggaagaaaccacatcattcttggtcatcactgtatcctcaatgcctagtgagtgcctgacatgtgatagatgctaacacatttggtgagtaaagcccatccaataataccccattgatcatgcagatccacaacggcttactgaaccagagcatttaagggtcagttcaagtcatccagatctcctgccccaattgtaattgatgactctctgcctataacctatctttgccaacatttagtctcatgagctattcctgatcgcattccctttggtttagctgtaatattctggactagcctacttcaagggacagaaatttcacaatatacgccatcctcagattattactaaaaatggtcaatgtgtctgggattgatttgctgaggtaaagtgataactactgcctgctcattttattattggtacccacctttaatccagttaacaacaaactttcccaatttacactaatacttaaataacttttagtatgaagcaccaaacattttccccataatttgaattgtgcccacagctctctgttgccactttttcttggctttccagaaaaaaatataagccacattttatactactttataaagacctcgttatctttcacacccctgccccaatggtgttaacatttaatactcttctttattcaaaccgtttgctcattaacaagtgaaaatatacctgttgttccaaaggctatgtttggaagttatattagcactgtcctgttctacagaagaaacaaggaatttggaatagtggtggagaaaacatacataactattcatacgctatttgttttctctatgcctaaatacttaagaacaatgaagactggggaacttaaatgtaagtgaagaacaagtggccaatttcaagtgattaatgtaacttagatggaatcaaatcttgggattgctataaactgatgaaacaaggccaatgaattatatatgcattcagtaatatgaatcaatgaaaacttaatttcttttctcgtgtaagattctcaattatccagaaaaggtgaaacctcaccagctgggacgtgcatccctatctaggattctatggcttttttttccacaggagggagcacccaacaagtcagctgttactctgttccagatcatgtgactgaagtactcccattatgaacagccatgtcccatgggctccagggcaggcatctacacattctccaaggaggctaacttccaatgactgatcaagcaaccagcagcaggtgacaggctctgcatgagatcaagtgtcacaggaggcagtggaaatgtggttaaaggtaacagctaatcggtgtgcctgggctcaaaactaggtttaattcataaccagttctgtgaacttagaactaagttcttcaagcctattaccacaattctaccttctttatatggctattaggaataattaaataatttctaatccacatgaaaagcttcagagcctaatctatgtgacattataaatattatttacctctacatgcatctgaaaatttaggtaaatgcccagccccttaaagtagagagaaacctgggtccattacagtgttctagaacaatttactcatgcagtgacattcactgctttgtgcaattcagatgagtgtaggtggtgtgtcttaaaagtcatcctaaaatatatttaggaaaatgggtttatatttaatgcttatataaaggctttgaaaacatacctaggtcagttatgtgattttttttttccccaatgtccactcttcagtttatattgtatctttagttcccagccacattaaaaaggctccaagacaaaccttctcaaaaacagtatctttcagtgacattgtcaaagaaccattttccactaccacaggcaggacaggagtgattagattatatataaacttacgtcggtaacaatgtttaatgttaaacttacatttagggcattatgagacttcaccatttacaaggcattttcacaaactacaatattttgtctgtgcctcacaacaaccccatgaggtaggcagcatacatattagtattttatagctggggaaacaggcacagacaaggtaaataacatgcctaaggttatacacaactagtgttgaattctgggttcaaactctgatctttctctttctgtgtcctggtctcctcatccagttttccttcaataatactatggtaagtgagtgtttcagttcacttgttctgagttgggaaaaattaaatgaatcctggctgtttcttaaaggcatacacagagaaactggccacagacagaaaacaggatgttgctagaaattagttaaaagttattccactttttattattttgagacggagtctcactctgttgctcaggctggagtgcagtgggtgatctcggctcactgtaacctctgcctcccgggttcaagctattctcctgcctcagccttccaagtagctgggattacaggcatgtaccaccacactggctttttttgtattttttagagacagggtttcaccatgttggtcagcctggtctcgaatgcctgacctcaggtgatcagcccacctcggcctcccaaagtgctgggattacaggcatgagccaccacgcccggctccattaatatttttaagagtaattttttctaagaaaagagaagtggccactaattacaattaaccaaagaaactacacatcatcattagaatttttaaattaatttttgttactttctaattctcaggagtaagcaatgccattttcgttcactttcaggaaataaaggtgtaagaaagggtaattgccttctccttcctcccagaccaaggctcaaggtcctacccctatccctttatttactgttcttggaattaaaacagcttcctttcccttccactatcaaggatatcgctgtcatcaaaatcctcccttcctggaaaacatttcttctttcatctaaaaagattataaatagaaaatgtatttagacctaagtgggaagaaggctgatagtgggataaggactcacactctggagatcagttacctaaggactcacactctggagatcaaatcagttaccaaactaaattttgtatctgaccattaccagcaaccttctccattccgattttttttttttcctgtggatttagatcttacaggtgccttcatatgcacctacagaatcatacaggggctattttcagaaagtgttaagtatctttttggttctacaagactaaactcccttgaaggcccaaaagagttcgctttaaatgacaaattctatttagaaatgcttcaaaacaatggacttccagcatatgtcctactgaggtcaaaatagcctctttctccactgcaatctgttctccattttccatttgctggattaatatatgagtttggattttaaattttcactgccacttaaacaggtgaatatttaatgcatgagaagcaaggttatgaaatgtcaaaactactaagtgaaggatctaatttaagaggcagccagagagtctgcaatttaaatatttaaagatgatacagggagtacaacactgaacaccaatctactccaaagatagcaatttaaaactcaggtttattctggaatttctcacaaaagctacgagtgatataataaacaaagacaagcaatactgagattatatgagggaaggggagggacggggaggcagtaagtacttgctactacaggtaagtaaatggcccatggcttctcaaactgttcttcacaaacaagactagactagacaaaataaagatagaatatatttattgaattatgtcttgaaaatggaaccgtttgaaatatagtgtattacttgtaattaaaagctcatttcttcatcagcagctaaaactaatgatacattaaacatacaaagatgagtaacacatacactaagagtgggctatcaaacacaagttgatcaaaattatacaaagaaacaaaaccatcttatgaattagtactttattaaatgtacatagcaatgtttaaaatcccagtgcatcactatcagaagtccctctaaatgctttcgtccaaacacacaactgctctcgtttctctgattcatcaatggaaagatcagtgacagtggacattaataccaatagattaaagtgataaggtctataaatgaacaaagaagttccctcttttttaaactaaaaacatttgagaagtcacccactgctaagatcaccactgaacaacttttatcacttgtcaattactgacccaggactacaaacattaaacctgaaaattagacacttgccactttagacttttttcaaaaagctcctttcaatctctccagctgaaaggtcacagttatgcctatttaaacggacagttaattgctgttcatattttttaaagatggagtcttcgtgggactatctgaaaaatgacactataactcaataaaagttagctctaggctctaagtaagcagtagcaaaggtcttgtgacagcatcatggatatttggacaggtggctacatcggaccttccaaaatgagctcagaagtatagtacacagaagaagggggatctctaaccacaactcaggccagagacctcaaaattcacccaaaaggaagatgtgtactttgatctgcttctaaattcaaactcctaccaggaacaagtctcaaacacacatcaaggcatacatgtatcacagtccaatattaagttttcaataaggaagggcatatttcacaatgggttgaaaatgaataagcctaagataacaataagaaattaagtattagctccagcaaagttagagctaaaagaaataatcacatccaaacaggaaattttataaaaggtattaaaggttagggcagttatctttaacggatattccaaaatataggatttagaaaactatcagtggaaaatacacacagaaccttaaattttatcgtgactggatttgttgaatgttttaagactaaacaattgctttaattcaagtgagaagttcagagataccacggaatatatttgataatgtcatcctcaacttaaattacctaaagggctccctaagactttcagataaattttagaattcttattcctttatggtcagagcactggctacctcttccatacaagtatacaaaaccttcggtagtattccaagcttcctgctctcacttctctgtgttaaaaataagctgccctccttccaatcagctaaatttcagtcatttcagacacctcatgggtatcacctagtccctaaagtcaacactaatcagtcctctccactacagtctgagttgggtgcctcttacctgcacccacactgcattatatgccttgttttcttaaatactgacttaaccaaaatgtacttatctcttaaccctttcttgtgactgacttaaccccttgaaataagaaaccttgtcatcatcctactttgtacatcctggtaactaccacacactcactgtaatgaagatgatttataatcacatattaaattgagagtttatttctgaaatactgtttaaaagctaacagaagccacaatctttgtcatatacccaacattatacgcattggtactttgtgtacagactacaatgaaaattctattaatcatttcaaaaatgaaatttcatttctcaaattggggattcaagtccccagaggcgacacaatcttcaacaaagtaatatggtgctgataggaggctgtggggcggggggagtcttaattttggagcaaaaagaaaatacagtgatcatttagtccaatttctttgtatctgggaaataggaagactgaggcacagaaaggtgaagcaacttttccaaagacacaaagaaaaagagttgggtgtaggactcgcggtcttagctcttcatcacgggattttccattacatcattagctgcaacacagtcttcaaaatcataaaatcttcctgtgaaatgacagtgactgggacaataatcagacatttccaaggagacatcagaagagctattcctagaaaataagaaccttagctttgctacatagaatattttcttgtatacacataaggaaataataaaacacatcaaaaaaactgtcttaggacagttattataattcttctactagtaatgcctgagaattatttaggagatgttggagaaaaaaatctaattatttgggagttgaagagaaaaatcaaactaagaatcctgagactagtactttccaccaattaaaacgtaccaacctacaatagctagaatctttttgatagtgtctctcccttttataagattacaaaccaattaacaggaaaacagaatggcaactggctgtttacactaggggagattctcattttcatagaattttcaagttttagtgcaacatcattaaatattagtcaaggcagttgatcttagcttcaacttaaaggcgacctaggaataaataagtaatgtcataaaaataagtgatcctatgacattgttaaagacaataataaatctactgaatagccacagaaaaataaaaagtgttttggctgtaagaactgtatatcaagcaactgatcatcaactacagacttcacaaattagaccacctttttcacacatcttaaacagcctctgacaaactacactgcactgagtgtggtttattaaatgctacccaaacagttgcatccatgtgtatcaaagagggtctaaataggctgccctgacaggcatctcgtttttagtaaagtacaactggtacataacttctgcccttttattgttgtttctccttggttctagtatgaagttggttcaacaaggacatctcatactggtaaaggcaaatgggatacatggtaaagatattcttgaaatgcaacttaggccataaataccttaccatttcttaaattttttacctgcagagatacttaacagaaaataaaacaattgagcaatggtagtggatatggcatctgaggtggaggcagtgaaatcaaattcactatggtagtggcagtaggctagccattccaagtctaagcaggaacttgtcaatcaaaatgttccatgttccatttccaatcctgtatatttcacttagccttttcagactttagaaggtgattacactaaagtagtataaaaaatagatgggagttttagcgtaaccaccaaagagtctattcctaccggtagctctctgcattagaaaattgtcagtagtggttaagaatgctaactcccttacttttaacttcagaaatgagcctgcatttatttagccacataatatttataaatactaagtaatgtgaataggctgcaactgaggcaagcacgtgttagcttagcaccaggttcaaaaatatattatacaaagcagaagagaatacactgtaactggtaaagttctggccactacacagcatactatgaaactagaggttaggatggaatgtttggaccagaaccctcccatgttaaggagtaaaaacatatggtatggagtcacacagagctaggtccaggtcttggctctgttacttaccagttaatcatttccttaggtcttctatctctttatttgtaatttgatgttaatcacagtacttacctcatggaaaccttacaagtattaaatgcaacaataaaactattagcaaagagcagaggaaccataaatgttttaatcataacatcattttatatacatacataggaaacaattcagataatgatagctcctaacacttattgtttaccatgtgccagacactgttctggatatgtaacatatgttaattcaattgctcctcccaataagtttatgcagcatcatcatccccaatttatggaacaaaaactcaaggaatactattatctttgaggtcaggaaagatgacacagaggaggagacgtggcacaagaacaatgtatgcactctaacacagaaacagttcaaaaatcacatatataaatgaggcttcttccaaatccatggtgataattattaaagttaattcctgaatattccaaatattttgtaagatgacagcagatgagtgtgctgggaagcctgcagcctggatggagggaacataaggaaggagctgtcttactgacatacagagagcaaacattcaacatctataaatgggccaacagttaaggccccaaaattttatttctcccatcaagctgttacatattaaacctctcactacctcaattctcttttgtagagacctgttgaacctaagccagtaaaacgtaaaatgagcgattcttttggatagacagtagtagaaatataaatgaacttcatggaataacttctatcttgagatgaaggttatgggtatgtttctgcatgtgaaatgtgttacaagctaccatgcaatcggccacctgatgattcaatatgatttcccagttaaaaaaaaaatactgaagaggctacactctcaagtaccactataaaactttcactttagacattttcattaaatatactatgaatacattcgagagactaaaagaaaaatctcagtactcactagtcagtactcagtattttgagccttcttaaatacggccagagaactagactgcctcaaagcttcctcccaagttaacagtattaccattcaaagcttttatattactatgttttatacttctagagggagggttgaaactaagtcttatatgatgcctatctcacatagtcccacccaccaagtagggactctactacctgttgaacgtatacattccatggccttgtgcaggaggtttttcttttttgaggcagagtctcactctggagtgcagtggcacgatctcagctcactgcaagctccacctcccgggttcacaccattctcctgcctcagcctcccgagtagctgggaacacaggcgcccgccaccacgcccggctaattttgttgtatttttgtagagacggggtttcacagtgttagccagaatggtcttgatctcctgacctcgtgagccgcccgtctcggcctcccaaagcgctgggattacaggcgtgagccaccacgcccagctaggaggttgttctgaagtacctctcaagcaagatgattagaagttgtggcatttgcccaaataacttggcttttgctgcttcactgaaaacaacgcaggctaaattggcttgcagaaaatcagatatattcattcaattgttagaagcccattctccagcaatggcttcagtattctttcaagattctgaaacttgacccaatgacatctcgaacagatgccaatactatcaagataaccatggcaactttatctccaaaaatgtacttaagatataatttgtgtagtatctgaatgtctagtatgcctaagacactgtcaacagattaaaatgctgagttagaatgttaaactaaagaaggactacacactggctggcataaataaactgcaggtgtcttagaataaaaaacaaccagtaccggttggtaatgtgaaaaaagaaaaaaggttctcatcaagccaattttggtgaattaaacatcctaggactttcatacacttcttcatccatgatctgacagagagaagtacatgaaaaggagaagtggataagacaagagacgggtaggtggacattatgtagaaaatctcacataacgggatacctttacttaaatctttgtttttcaccacatgttctcactcataggtgggaagtgaacaatgagaacacttggacacagggtggggaacatcacacaccggggcctgttgtcgggttgggggaggggggagggatagcattaggagatatacctaatgtaaatgatgagttaatgggtgcagcacaccaacatggcacatgtatacatatataacaaacctgcacgttgtgcacatgtaccctagaacttaaagtataattttaaaaatatgtatatataaaaaaactttgtttttgtatgaaacaaaaaagctgttaagtcctttacatatccttcatccgaccacatcttcaatgtatagtgacacctaccaacaagttttgaaaaacacacccaaagttaaaaatggcattaaaacaaaaacaaaacaaaacgaaaaacctccaagaatctcaacttttaatttcacttaaactgtgacttttttcgtctttgagcacacagagcaggtcttcactgtctcttataagcaatagacagaagcttcctcatgcagaggttataaataaaaacattctgcaagctgctctccaaagacaaaaatcccgttgccctcagagagcagaccaccaaatagatgagaaaggaaatgtatagttaagaaatttttatccactttattaatttattttatggccaaataaaactttatcaatgacagggttagagggccatgtaggcagagaataatccaaggcaatggagaattaggcttccatactgaatgatgaagagcccagctgagccagaataaagatttctgtaggacactgacaacactagaacagtgagttgagggcagagtctagagaccttgaatgtcagggcaaaacttttatgagcagaggaatgacaatctaaatgttggtaagtattatcagacagaaatgtatggaaggagaatacagagacagtttcccatcataacgcaggtgaggagaacagtcaaaatcagtgtggtagtaaagttaaatgtaaatgccatctacagttaagtttccctttgtactataactagaagaaaaactgctttgcaacaatgttcagaaacccaagtcttctttgacctacttcatatagtaatgaaaatataatgatcctttcctctgtgtgtacactaaatactgcttagagaaacttcatcttgataccatttgtaaatacttaaatgagtcccatgggtctccacggatctttgcagagcaaggcaaatatgtttctacgagcaaattacttgatccacccaaaattcattcctattgtttctcttataaattaggtcctcactaaagggggataaatgtaaagtacagggctaggtttaatcaaattttcctgccaatcatttttgtagaaggttattacttgatagaataagtatactttatggtgttcagatgtaagcttctcctaaaaggtacacatcacgtgaaggcctctgtgcttttgaatgagacattcccttatgtgtaatacatttcttctttttccgcccaataaaacctagcttgtaaaacaccatcaactctgaaatcaacacagaggcctctagacagcaagtggcatatccattttcattgtattctgcacttactcatcatatatccaaataatggtcatataaactaagtgctgtctcccttactacacaatgacatcaaggacaaggctacctcttgtcttattttaatgctgttcaaacatttagcaaagctaactagcccacattaagcactcaaaatgtttataaaatatttaattacagatactccctgtccaacactgtatagccaagattacatggtctcagtaaaacaaaaaaacaacttgcaattaaatacttctcaaaaacttttacatttgcttatcctggccctttgttttgtgggcaaggtgagcaccatgcacatcttttaaagctactgacctttcctacaaacttggagacaggcctattagtcttgttatggttccatataatataataaagccctaaggggtgggaagtcttgaacataaagtaactacttctactaaatctttaacgtattttaaaaataggattcctcaaacacccagagaaaaattcctaacaaataatcttcctcttaaaggatgttttatgtcaacaatccccatttaaacacctgttttaaatttaaaacacaatctgcaagccctatctacattacaagtaaaccatacgctatccaagatttagtgttttgggccctgatttgacacaattatcagggatctaatgtatgtatacaggtatacatacacaaagaagttaggaagccagctcactttctttcaagggcagcctgtctttggtaatcctcaatcagtagaaactgtaccagttttttaaaaatttaaaaagcagtaacagcaaacactgcagattgcttatggcatttaacaggcagagatggaaatttgtgtaaggcacgtatgataaaggagaaagcaaggaaaaagaataacagaaatgttattaaaagccctccccacagagccaaaggaagttttacctacacatattttgtggggctgacataagttatgcaactatgaaaaatttattcaatacataaggggataacccctgaaacattagtgagtgttgttttatgactttaagtctaccaagatatttctctcacaacatgattagacattagagaataaccatagggaaagctttttttaaatgaactgatttgcaagactaatagtctcattcaaagacaatccttcattctccaagtatctattagacacctgagctgtatattccccctaacagctttaacaaaaaataattactgtattcccaaaaccctttgtgtgacagttgtgaagattttaaaagaaagagtttttaaggaaaacatggacaaccttcactgtacgcaataaagagaccatatcattgccatctatgcaacacctgcagaaatttaaagaggggcagcgaggaggggaactaccacctttatctttgttctaagacaaagtgttctcctgcttcagatctccagaagcaccttgagaatcccgtcctgagatatttaattacactgaatgatttggtaccaggccctttccctgggtcttgctgactgatagcatcaataacactcactggctgtaattaaaccgccaaatagtatcccctttgccacttggcagataaatgttctttaatactccaaagaacaaagtacaaaggtgagaggggtgtttttacccctcaccttcacagttcatctgactttgtgcaccaggatatacatatactgtagacaatgcatattttacaattcccctcagacattgcttaatgaagaacatgaagaaaaatccttggtttcttattaattcatttttgcaactctgagcagggggaaaacactgtaagccttttggcaagagtatgcactgctttcacatagctttggggcaacatttggtttacaggtcaaaagggtttctaaattaagtttgcatatagcaaaaaattttttcctttaaaaaattatagcataaaatgtgtggaagctcttataatagagcaaattcccatttattgaggccctggctagaaagctcaaatatcaagacactgggtagggaaggaagaggggtttggttggcaggctataaaaataagacaaatttttattaaattttaaaagccacttttttttttttttttttgagatgggagttttgctcttgttgctcaggttggagtataatggtgtgatctcagcttactgcaacttccgcctcccgggttcaagggattctcctgcctcagcctccccagtagctgggtttacaggcacctgctaccaaacccagctaattttttgtattttaagtagagacgtggtttcactacattgtccacgctgatctcaaactccggacctcaggtgatccacccgcctcagcctcccaaagtgctgggattacaggcgtgagccaccgcgcctggctcaaaagccactttcaaaacttaactcccaatctctataagacaccctttcaccttttttttttgagacagaatctccctctatccacccaggctagggtgcagtggtgtaatctcggctcacagcaacctccgcctcccaagttcaagtaattctccctgcctcagcctccggagtagctgggatcacaggcacccgccaccatgttcggctaatttttgtactttttagtagagatggggtttcgtcatgttggcggccaagctgatcctgaacttctgactgcccacctcagcctcccaaagtgctgggattacaggtatgaaccactgtgcctggccaagacacccattttaaatggataggccctaaagaaccatactgaaaattctccaaataccctcagaagcaaataaattatgctagcataattgtaatgttgaagtatttaatgacacacaaatgccctgaaaatgagcaaattgtgtgtgagaacgtgcattatttcttaggtaaatccagcactatattcattaaaaacacattagtgaatcccagccattcaacatatcttgatgtaaccgacaaatgaaaatcctattttttacaagtagacttgttttaaaataagcaccacagacctacccaagtgcaaatcattaagatccactgaacagtgtttctcaggtcaggccaccatctgcttaagaatcacctgtggtggctgttgaaatacaatttcctcagtctctctctgcagataatcagattcagtaagtcctggttggggtgtagaaatctgcatttttaatcaaccaccccaccccactgatcctgataaacattaaagtgttggcagtctcttgtgtaaaggcatttgaaataatcctcaaaactctgggcatattagggtttcctagatagctcataacaaccacggatgccaagcccttttccttgccatccactgatcgttagtttctaaataagacaaatgccaggtagcttgaaagcaaagcatttaggaatataaatcacctgcaaatgcaaaaatgcagacgtaaaataaagcccatgaaactcatccaaagatatttccaagaacccagactggctggatgtggctcaactgggttagcctcttcaaaaaggccactgtgcttgattctatgaagttaggagcttctctcaatgactctttctaggaatatgaatatggttatttggttaaggcaagcacaaatttctagatagacatttaacaaccaaaactagaaactgaaactttttctgaattattagtttccaggactacatgcttgttctatttttccttgcccttcctgcagctcacctgatcaagaaaccaagaacagaacacaaatccaagacttacacctccaagtcctattgcagcattcaaaagagttcttcacagaaggaagggagaggaggcaggcaagtatcagatttcctgtactgttttcaaaatacagatgaccctggaacaatatgggtttgaactgtgtgggtgcacttaatatgggattttagaccaacccctccctcttcctctgcctactcaacataaacatgacaagggggaaggatccttatgatgatccacttccacttaatgaacagtaaatatattttgtctaccttatgattctcttaaccttttcttttctctagcttactttatattgtaataacacataatatgtaatacatgaaacatacaaaatatgtgataactgtttatgttatcagtaaggcttctagtcaacagtaggctactagtagttaggtttttgaggagtcaaaagttagactttttgctatatgggggctgctacccatagcccccgaattgttcaagtgtcaactgtacagctctgtctcattgcccaaaagcagcatgtcaagacacttctggaaataaaacatccacaagtaattctaatgtagtacatgcgggtgagaacacacactaaaagtaatgataggaatggctggcagaagtgaaaataaaagaaaatgcaccatccatgcttttttaaagagtctacgcaaatttaaagagagaccaatgttaacacacatttctgtaacctttaaactagcatctacgacttacatgaacctaccagaaaaacattgtcgaagaatgcgtagctgcctaaaaaataatttcaggaagttactactataataataattttactgttcattacaactgaaataactgaatcaatgttaactcacttatctgctaagtatgacctccagatccagttttcttctcaaactgtacgtctggctgtctcaagtgctcactctgcaagagggcagagttcttcactcctaggcaaagacagctccactctctggcacctaagagatctggtccagaaagtctcaagacaaagacactcaaaggcccaaattaaggcctctctcagttggtttatttagagtggtatctgagcaaaacagtttaacatcaataatgtgaaatggaaagaaaacaacaaaagctacggcatcagccaacatgatactacatttctgatgcttattagctatttcattttgaacaaatcccttttaacctgagctttatttcatcaaagggattaagtatttgcctaccagagactactgctgtttctgcacgaattcaaaacagtaaaaagataatagtcctatgaaatttgtttcaaaagtagatacagcaaagaattaagggctccttcttgggaagttaacacaatcatcttaacttcacaagccaggtatgtggtagaacagactgaagccaaactgacctagcaccacttttcccaggtgataaatgaaagaaaagccctaccccacattccccttaaaaagcagtgggaaagtaaagcaacaagggctagcagtgtgatgttcaggtagaaaagatttttgttttcttcttgtaaatttgtttgagttcattgtagattctggtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaactgaacaatgagaacacacggacacaggaaggggaacaacacaccctggggactgttgtggggacgggggagggatagcattaggagatatacctaatgctgaatgaccagttaatgggtgcagcacaccagcatggcacatgtatacatatgtaactgacctgcacattgtgcacatgtaccctaaaacttaaagcataataataatttaaaaaaaaaaaagaaaagatttttggccatccagatcagtttcaatttatcttatctcactgttatcttagaaatcaaactcaaacacatttgaacatgtggttcaactattttcagtgtcttctatcatgatgcacatggtttgcttgaatctcttcctcagcctccttattattcggaaaccaattttgcacttaacattctagacctgtgagctgttataagggttctgcctcaatgactcaaatttctgataaacagtaagtttcagtgacatccccaccacatgcccctttcaattccacacgtgcacacacacacagacagcaacaatttcctaaacctatacaagttattacttctgtggctttccccctaccttacacagaagcaatactcacaaggaggcagttactcttttaattccaatggaggtcttcataaaacctgacattctccatgctggttacagaaatgaaatagccaggcttttctggtatagaccatactttgcataagtttaagcatctgccatgaggggctatgatacccctgtggagcatgcttaggtaacaaaatgatccatcaattccaataaagatgggttcagtcaactgttgagactcttctaccatcactatccactgtgtggctgacaggcaggaagtaagcaggggacactgccaccaagaaccctgttcctcatccttccctctttgtaggctctgcctctgctccaacaactgtgggaaaatctaaaggaaatccattggaagaatgcctagttattgccctttgagaattccaattaactctcactttggagttggctaaaaggaacagaagtaacacaagaggcctgaggacaggacattcaagctctggaccttacttgggctacctacccacattccctagaccacattagatgagtaagaaatttctgggctttttgtatgaaaaaaattaaagctgacaagagagcattctacaaaacacatgaagggcattatacaaataacaataaaaaagtcatctgtgacttctcacttcaaataaggactatgtaaatgggactcaatatagatagaagcattttatttaaatgtattgaagaggtgctgataatcagatgtaatatactgttaaaacttgacatgtggctgtggaaatttccagaatacaagttaacaatgaagttaggaaaacatgtactcggtcagtctgtattttttaaaaggcagaggaacaatttactcaacgtttcaatttttaccccactcctggcatatactttttcaattttttttttgtctggataaataacagttattaggctaacatctcataagtaggtcagttaatttgaggcctgttcttccaactattacttctaaattttccaaatctgctcaaggtaaaggtttttaaatgaggggtactttgtagacgatgatttataaatttctaccctttgtaccatcacaggaaataacaaactacacaagccagaaaaacactagggtgggttgaaatgctgagaaagatgtggcgtttaaatacaaaacaaaccttcctctccgaataaatactcaaggtcaatcccaacactactctgctcaaaaccctccggtgccccttcctcacctagagaacaaaacatcagcgccttcacatacatgcgcacccagaacacacttctataacgcataactcaggctcatttcccacactcgcctcccatcctgctttctttttgggcaaattctatatggttcccctatcaactgctttaaaacttccatgccctactaaagtcatgaactcccagcattatggctattagagccactcgtctcaaacacagaactgtgctgcaggtattttaacagaggacctactgggtggcaagcccttagcgtagctttacttacattcctgcctgcataccctctcctccttctttacagtgggggctggtttacacagcatctaagaatatttccttctggccagtattaacttttataaaagaacaaattataatgataaagaaaaaccaacccaatcccaataatcctgtcgcaaaaggaggttgaactagaaactcaaatccccatataaagtttacagtggctattaaactttcaagagtgaaagaagaaggcaattaaaattattctctcttcaggagaggttgctgcttttcatcaaatcattttatgcaataaacatgaatttgtttaaaaagttaacatttcttcttaatatgcaacttagcagaccatgaaaagctttttttcctctcctaaaaagcaggtaatgaaaattctcagtgatgaataaattattttaacgatataaatggaaacttaaatggttaaaagctctgtccaagattaagcagccagttaaatcattttagtaaggtaatttagacagagtaagatttcagaaatgtagttctatattcctatgttaagggtcaagctcatgctgaacagaaaaaaaaaagtataaatatgacatttactaatgaggaaaggataagctagttagaaaaaggtataaatttaacaaaaagttaatggcaatacagtagcttagaatacaggtttcttaggtttgcttaatcactctcaaactgaacacaaaaaatagataatactatttataatattctcatttttataatagaattttccaaatgtggttaaattgtggtttatttcagtataagaaatttcatgattgtataccaattaataacttttaagcaaaggtaaattttagcctggtctatagctgaatgattaaggaaaatatttctttaatcaagaccaaaatcgggcagtttttctatggtagttaattctagacagaatttttttttcttttgaggggtcagaacttaccaataacaataaaacattctattccctgagataacagctccttctttccagataaatcaaccccagtttcaggaaaaataaagcatcctaggcccattgtagaggagggaaaagctgagagagatgctgggagccacgtatccatttcactgtgttatgtgataatcacctatccagagttctttatgcagaggagggaggaagtctacacatattcttggaaatgaatgattttagtttgctaatcatgaatttaagtctgacaccgttaacctaacaagtcaaaagtattggctttaagccataaaaattccacatactatttagatttttttcaatacttaagacccctaaaaataaaatgagtagagaaagagcatgaagactgaacacagtaggtacaaccactcacttcatgaataactcaccaaaggaaggattcctttagggacctgaaggatcttggagaaaaacctctcttcttctcaccagcatacaacttgacacttccatgagattactcccccacccccatgcctgaactgtacacatatcaccttttcactaccttccctaatgagaatcttaaaacatttttgtaatattcacactttatttaccatgtcaacactggggatactgtgggcaggcttaacccaaaatagctgcctcccatgcagtacagggatgatgtcatttcaccagcaaggtatgcctctgggacatctccttaaccaggaaaaaaagtgacctttaggacaagagaacaagtatctcgagactttaacctgtatctgctactacttaaacaaacagcatcctactatgagacggatacgttgttttcaatttctatgccatgtttttttataagcaaaggctggtgaaccacgttgaactctgaatgctaaacgatcgcccagcatgctcaagaaaaaacattaatattttggttaacagaatgaaccacaggaggattattaaggtaaaatgctagaagacaaactgaactttgcacacacaaataccaaatgtatagagaaccgccaaacatctttggtgattcccaagtgctaggccttagacttgctgtcataaattacctgggaagcataataaaaaacagaacccggaatctcacctgtggacagggatcgagtagatctacagtggatcccagaaactgtatttctaactcacttcccttgggattaagatgcaaccaaagtttgggaacaaatgctttaggtcctcacagagcctgagggacttcacttcactcaccatggaaatactgaacatctgtcatttattcaacacaccaactactgcacaaaaccctactgagctaatgctattagggagccccaggagaaactgctaaataaaccacctttcacagcacttgattcactgtttcaatatcccaataaccaggaattttaccaaacgcatactaaattctaagtggcttggagtacacaaacacttgtatatactaaccaatcttctgtacctttctaaagtaaagcacagtgtcctggcaagagttttgatataacgatcagaagacaaggatttgtttgagtcgcagctctttcttcaactgcctggtcttggctaaattgtatgaccaccaagatctccactctgactgtggacagagaacagtgcttaagcctaaattacatatgggtccccctgtaattccaaaacttctgtggttcctcaagggtaaagaatatagacttcaaagaagggggaactcagcaggagctggaacaacctggaaagacagaagctgaaggacagaattcctttagatgggctccaaaagatgagatgaccacagttaaactaaaaatgagtgtgaaagggtataccaaaaagtcggagctgcaaaagcatatgcatggacgctgggagtaagatcagcttacaagtaaagagccagtctgagaacagtggagaacggcaatagcactggcatcactcctacaaaactcagccagatgatagggtaaaacagtagagaaacaccatagagttttgagtgagcagtaacacgagtaaagtggtgctgtgtaagaaagtggtgctgacagccatcaccagtatagattagacgagggaaaaagacttatttatggaatagtatcccaggaaatgaaaaggcttaactcaacttccaaaacattcttaaagctgtgaatactagaaaaacttggctcaagacattgtacaagagcacaaaatctgtctaatggaaataaataaacatagaaagaacaaacaggcaaagggggtgctatatacttgtgggaaatggtctgctttgcctcttagacaaatgtgggccaaattgaggatgccagctgttatctgatatttttacaggaaccaaataggggcggggaaagaagtagcctgctatttgcccattaccctgacccacatctcagaaaatcagaaactgatgtcacactataaaagccacaaagctttactgtgctttcttccacatattcagcccaagcagctgggccctaaagagaaaaggctggatgatgaacagtaaggaagcagctgtcatcaactgtctccttgaaggccacgggcatttctcctgtggagacctatttcccctgcatttctaccttcttctggatcttcgtgcaggaggatatttagtaaaagaactgacacactagaatgaaataagggtaattatttctagaatggagaaaaggatagttcctgggacaagccatcttgaccacctattccattttcttcccaactacaactcaggacctcagaactaggacaaattagcagcaacgctggaaatcaatataaattgaggaaaagaaacctgcaaaaatctgctgtaggataaagagcacacggtctgacggtaactgaacactggatgtctttttaaagaacacttattgttacttaatagtactagtaaaagatctctgacacagaaagtatgcagagaaatatagataacgagaaaaagcagttcagactgaaaaaacttcaaaacaaacttgtcttacactttattggaaatctcatttttcccttcacattttgataatatacagtaaccagttcattttctgattggtgaatcttttcatagaacagtttcttgctcaagaagtatctagaattcttggacctctcataccctagtatatttgggaaccactatatactttcatttagataagacagggctggtaggcatttttcttaggggccaataaatataaagactgatgtgtcaaaaccactcagggctaataaattaccttaactggtaattctaagaaaagcaactttaaagcacaaaaatgacacttcatttccagatacctgaaaaaaatgagcaaaaatcttttacacaagtctctaagcaagatggatactacagtcagccttgactaacttcccctcaccacttcaggctatagtctgagctggtttcttaaatcaagggtggaaaataggttcaaacttgagtcaattgatagaagttgtctggaacactattttgaaaaaaatatttgggagccacatctagactctgtgagaaagagtgccatgattgactggcaatgtctgcactgggcaggagagggcaaattgatggtacagctaactaagaatttgctagaggcgacatccctcttattttctaaaggaaaagaaatctatgctgtgaattagattagctccctctcaagagagaatctacataagaatttcaaagattcacaaaagcagcaaagtatgtacaaagttatttactgtacgtcttaaaaagaaaaacaacagaaaaaataacctgtgtcatgtaagttcctccagtcagtctcctcaaagcaagctgaattagctagagcaaactacaactcaagcaccacatctagcctgccacctttttgtataacccatgagctaagaatggtttttacattttttaacttggaaaaaataaaaagaatatttgtaatacataaacatcttatcaatctcaagtttcattgcccataaataaagttttattggataacggctgcatccatttgtttatgtagtggctattactgctttcatactataaaggcagagttgagaagttgtgacagaatgcatggctcgcaaaaccttgcttattcactacccagacctttatagaagaacaagtctaaggtttcctcaagttatagggcaagtaattctctataagggaaggagacttgattccgtaggcttcctataacatttatctaagagagttgttgctctgtccccctttgcgaatacatgaatgattatacatagcactcttgaacaaacagtttcttccatcttgcaacaaacaccaaaattccactatgtctcccaggtaactgtttatatgggcccaaaaggaagaaaggaaagaactacaaataaatcttaatttttttaaacttctgttccgcaagtagatataaaaaaactttaaacatacttttattgttttggtttgaagtctcaatccattcagggtgttgatagctttctctgcatccttggggtcaatgtagttcacaaagccatatcccaagctctgccctaatgaaaaggaaggggaaaaaggcatatattagttctatactgttgacagagatcaactttcattttggcatatggtcttgtcattaacaccagcatatttcctcaacagtaaaaagaactctctattaattctagaaatatacatgaagtctttatgtctcctgtctactacattttcaagttttagaactcagcaagcagtgctgtttaggaaaaaaaaaacacacatccccaaaggattccaccatccatgccctgcctgagccagagtataccatcagcaagacaaggtcagcttcataaactgtggggataaatctctgtgctatggagagggcttaacaggcaataccttttcagcttcagtttccttagccataaaaatgggaagacagaaaacatcaaccaagaatctgtcagtgttcagtaaattgtaccctgacatatttacagcctttaccaagtacaataatgtcggagtctaaaatggtgaagaaccatgtgtgggcgtgtatacatgtaagtttattttagacgagggcttatcttcaaatacactcaatcaaatttctccaaagagggttttatgatctagataagaacaggaaaatatgaacacaaaagacttacagggatgacatcgaagacaatgagaacatataggaaaagaagaaatagaacataaacaaaaataacaggagaaaaaaagtctagagtaaaagttgcttctaagtgtttgttgttgttgccaccctccccccatcatctgagccctctcactcctggttcactgatgccctagatctcagacaatgggagctatcaaaagcagttgcatcaatggaatgcaaagataactaaagtcaatcgcaatggtctcaacttttcaatgaagcaagtttctcagtttgaaatggcaagaaacattatacaggtgacaaaaatggcataagaaaagtttagtctacaaaagtcaaaacaaactaaatgacgatttcccagatgcccaaggacggtccaaatgcttttactaagtactactgttgcatcaatttcatagggaagtgaggtattttttcttgatggggcaccgtaggtgcaagtggttatcaatgtgggtttttaggacagctactctggttatcctaatgtggatacttgttaccacataaacgaaaagagaaggctaaatacagtgcccaatatgaaaactagtgattatattttgggaccacaatcagaattttggataatcactgctaatatatgtcctctatcaaaatgtattttttcctttttaaaaaagagaaaggaatagagagctaaaaactaattaggttaatttcatctcacactaaaattgaggttttattttacagttctagtaaagagtcacatgtgaagccactgtatttttaagcattcagcttttcattaattcaaaatttatcatgtgtttactgcatgcattgtgcccctcttatgaaaatgtgttgcagtcctattgtcattgagtagaattaaattggctgaatgtaacaaaatctgctcaaggaaccagcttatagtggaaagacagacttccaataccggctctggtgtttactggctcgcagttagctgtgcaactttgaagaagctacttaacacctctctgaaccacagcttccttctctctaaaacgagggtaattcctacccaactaggttgctgatgcaatgatgaaaatattcattaatgatgaaagtggatcgtcaccctagtcaaaagataacatgagaaaaaataacatgcttactgttaaagattttaagtatattcatttaaagttaaataaaaaagatgccacaaatataacagaaaaagaaaagggcaatacaaatatagttttgtcatactgctattctatgacaaaataaatcaattgtatcagcatagtctaattgccctttctactgatagatactcctcctcctgcatcttagcagcttctaaccccagtgcattctcaaacttgactgcaatggaatcatctagaaagcttaaaaaaaaaaaaaaaaaaaactaaaacaaaaaaacctgatccccgaatcccactcccaaaaatagatagatatatatacatatatgtgtgtttgtgtctgtatatatatgtgtatatgagatgagatctcactacattggctgggccatgcttgaactcctggactcaagcgatcctcccaccttgggctctgattttatcagtctgtcatgaagcattggtactagctttttaaaatcctggtgactaacgtacaaccaccatgttgagaaatcactgccttaatggtgagaacctagctggggctacaacggggctgctgggaggtctaagaaaggtcttgcagggatgactgctgtttcacagttgcgttgtttaggtacacgtggatgtgtttcttctaaaatcttcaagttacctattacttcaaagaaacagtttattggcctcctgaggtctgtctggggcacaagagtgcctactgagattagatcactgggtaaagtgaaaagcctgtcttgcttacttcctacttagctgtttcccactctagcctctgaacccttactcctggcctgctgtaggcatggaaacatttgctaaatgaaagaatgagaaacttactgatgttatttatttaaccaaaggtattatcatcatcaccaccaccaccatcagaagacccaaccatcaaatgggtcttccacctgataccctcaagcaatcatgactagctatatgagtcagtcaaatatctagtatctgttaagttgtttatactcagaaatatttatccccaaatgactttgcctccttataaaaagtttcttatttgcctagtggcattattaggatgagtgccactcagaatatgtttgaggtaagcaaaactgtattattatcctaagcaaaataatatgaaagggggtatctgctattaaaagactgcattcctaaacctaccatcgttggtgtattaaaatgttggcactataacaaaagggagttagaactttaaattactttacagtgaaaatctgtaatcaaggcagcaaatatttattggatgtttaaaatatattaagggtatcgcagatgataccaagataggcaagcctccccattctcaccttttagctacatggtattttactgtttaattgtagcttcacattaaccatgttcggtattcagattcttctcctacaaggtagaaatgatatctgaagcttggcaaggtcaatcagcttctacaaatcaaaaaggcagggaggaagtagtaaagtcaggacttgaagtcaggactttcaaatgctgtgctctactccactcaattaactagtttatacctgaactgagacttcaggcatattgcgtataagcccaggactagtttgtacccaatatgcctgaataataacgtaaccaggcacttctgacacttttaccgcaaaagttgtttcttgtttgattactatctcaaacttctgtaccttttatacaaatatcagttttactatatatgaatttcagtgccattattcattcctatgacaacataaattgcatcttatttatatagtgcatatttctggttataaatgagcgcacagtttttaaaaataaaagcagtagcaaggcaaacattacaaaaaaaaataccttacctacccttttcccactcttatattcatcagtaagtcatgggccaccagggaaggcttggaaaccaagcatcacttatccatatcatccaaacctatttttcaagtctctctgaatttagaatgtgcatactgataatccccaaactaagattcatttctttaaaaagttttataagatgctacatttaaattccaagtacaaccattatggaaaccaacatgattaaaagactattctgaccaaaatgacaaagctaaggctcttcaaaaaaaaaaaaaaaaaaaaaagcccttaagaaaaacaaatcctgtctttaaatgccaaaaaatttgcctggtaactgaacataaagaagaggctcaatgccacgtgtcctcagctattctcagaagctacctgtggtcaagtgttctaagaattttcaaaccattaattcaaatctttcttcttttgaggcaaggtctctctctctgtcatccagactggatggcagtgggcatgatctcggatcactgcaacttccacctcctgggttcaagcgattcttctgcctcggcctcccaagtagctgggattacaggcatgcatcaccacacccagctatttttttgtatttttagtagagacagggtttcgccacgttggccaggctcgtctcgaactcctggcttcaactgatctgccaacctcggcctcccaatgtgctgggattacaggcgtgagccaccgtacctggcccaaagtcttgattttaatggccttggtagggattctagaacttttgctatattctgtgctgcactgttgtgtatgaatgccttttgtttcacacgcttctttttaatctaacatacatgccacagaaaagaaacccttcttcacaagagatagaaaaatagtttataagatgctcctggcacaaggagaacagttataaacaggctggtagaaatcatggtcaagggatctataccacagagctgaagcactccagaggcctctgaagaggaccaaagactactgagagcagggttcagagcaaggagaggaaaacaggaagaaaacccgtttagtggcaaagtgctactgtgggaaacacagtaaatggcaatatatcccaaactgtgtgtaattcaaagcatcagctattcccctgccacctacattgttttaataccctactttaattaaaattttaattgcatattttaattaaaaatacacaatcttctggacctgtttcattcaaaggtcactttatttagtcttttctattttaaattactaccaatgttcagaaaaatcaaattaccccctcaggtttaaaggtaaaggcaatagactaccgtaattcttgattaaaagtatattaactttatccaaccaatattaaacaagaccctcaacacaaaattgtggaaaataaaattttgtatttaaaaaaaacaagagtcaccctacaaatttctcatctacaataagcattcaataactatgggaaccatactttttgctaggccctgagaatgcaaaggagaaaaagatctttctcataaagcctatattctgacaggaacacattctacagggtattagaagaaaatagagctaaggagaaaaaagcagcagggggtgagagtggggaggggaggagcagggctgctgtttaaatacaatggtcagagcaggccctatcctgcaggtaacatttgatccaaggcttgaaggaactagctcaagtctaacagtgaagatgtgcaagacgttccagcccaagttctgccacacccgcatcacgttctgccagtcctaccagctaaatcggccccttgtctgcgttagcattggttctctattattctggccctgatcactgctacactatcctaataggacaacccttgcttagactcccattaattccaaaaacagccatcctccaccaaaacattgtccaggagaacttcttaaaacacaaatctaaccatactctggtttccagtcactgtcagttttttgctcacttctactttcgctcatcttccaccactcctacacatacaccctaaaatgcacattcagttctctatgtctggaacacagctctccaactagccaactcccatgtatcctttgagactctctgaagtcatttcctgccacaacttgccccatccccagtgcacactgtacagtgctcctctcgactagtcctcccacagcttcttatattattccgttatctttgttatgtgtgtctggggtccatttggatgctccctcactagactgctgagcaagggcaagcagaacatagttcctgacaaggaggaccctaagacagatcattaaatgttctgtgaatgactgaatgaaaaacaaatgaaggagcagcagcatctgccttccaggagcctgtggtttaggagatagttgcccttataaacatgttcctcatgtccctacattgtaccagatggattacagaacttgtggagacaagatgctcaaatgttatagtaattctgccttcataaggaagtcatacgagttttaaatagttcatgtaaaattgttcatacgaaaaatttctacaaataccattaagatgaagtctcaattttaaaaagtgtcatctagagtaatttgatagatttacataaatctgttccacaaatcggtaagtatgaattatgggatgtcagcatataattttgttgaaagtactttttcactaatataattaagtctgctgagactattcatgtacaagtcaaataaaatgcagagtgaattctgtaaaaacctggtagttgaatcaacaataaaaggtgactacactgattgatgtgtatctattattccatttacagcagtagtaatgttttatgaaataaaagaataaaagccgtgtgaatctttttcaaatcccacagttagcagaaacaggtcactatggtcctctctgtcaaggaagacttgcaacctgaggtttaataatgcaatacttttaaaaagcaaaatggaaagattcgcttcctccaaacacagctcttgcataaaactgcatgccttaacgacaaaaaaaagcaaataatttgatttgcaaaaacaagttttcgttacaaagggggaaaatttttgtttttaataaagaccctgttgcctcctgatatccttctctctcctccctcaaacacacaataaagttgcaaatatattgtatttcttcagatggacttactgttcttgggcactcattatgtgtgtctgttcagacaggctgtgcactgcaactctggcaccaaagcaactcgcaccagacttcacaaaggagctttcttaatatctcagatctgatacacagcaaaaccatgtgggtaccacacagcagggaaaaggtttgagagaatctcagaacagagggatgcagttctctctagtcacgtttttctccacattttaattcctgacttagcctgagtctcctcaaatgtagcatgccagatgcagcaggtccttccatttaaacactcaagttaaggtgggtcaagttaaacaggtcttccttgctgccctctaatgagtaagatcaaattgtgagatggaggactggtgagatcctattactacagtccaagccagccttcctgaaagctgggagcatttctaccagcttcccaaaggacattaccagggattatcacaaggatggagaattcaacctagacactcacataatacagaaaacagatggctcactcgaagactcatcttccacccaaatgctaataaagctggcctgagactgaaaggccccaaagtttctaaatgattttcaggactttacagatacatggagctaatatagaagagtttaaatcataacttttctgctgaaatcaaagctgcaaatagtgatcatttggtaaatattacctaagcagcctaattctagagagagcggttaatgtcctcagcaccagggcattttcccttcaagttaattttaatagccatatctgtcccctgattatgcaactggtagagctctattttcctgtagttccagtcccagtaattatgaatctgctggcaatgcggcatgaccctgcttaagttggcgatactgtgggttcttaatatatcacattttcagacaacattaagaactcccacacaattcagtcttagactattgagaacagaaacagcatattaaatcctctaaattcttgccaagtattacaccgggtacacaaagatatcttgcatccaagaccaggaagatgaggaaaaattatgtgcagtaggaaaataaaccaattcctctacaacccacaggatgagactctacctgaaagcaggttctccagcctgaaagaaagtgactgagatagtgtagcacgctcagcaccacaatgaaaacaaaaggcggttctcatcacttattgatataggtagtttctctaaaagataggtcagcagttctaccttcaaacactggagctgccaccaggatagagcaaatgccaaaataccttcagatagcctgaaagtcatacctgacagttcaaaaaaggttaggacattaacaactctaggctagtccaatctactttcaattaaaagtttgggtatgctgcaactttctcatttctttgttaattataattaattctacacagatccgccaccgcccctacccccacccccacacacactaacagtcttatattatctgctttatcttgtgtttacttaaaagacaatggagttgttcaagtatataccatttgggatgaaggcaaaggaactgtattcctcaaaatagtattgtggtagaggaaaacaagttaactgtggtagtaaaaagggcatctgctgttgcttgtgcgaccagctggtgtcaatcttcacaaacatgcactcttgcctgtgcctgcacacacacacgcacacaccccccccactaagcagtccatcaagaggcagtacagcttcttaatgtgtttttctctctgtacaagatcattttttaactcagataccacaagaaacaaaaaatttaaaggccctgttttgaaactatgtcagagtccctgcaaaccaccatggagagctccccattttgtcaagaacgggaaactataaaattagactctaacaaactcaccaagtccatgtgaaacaaaaattctcgttagagataaattttcttcttgaacacatttttcttaaaaaaatcactctctcacccaaaagttaaaggttcaccagcccaaaccttccagtatgaaaaagtcagtaagtttgtcggggaaaaatgcccattcccactgccccataaatgctatgtctacctgtctggcagtcaacagtaccactgccaaactaaactatcaagcaactaggatccttacattacatatatcacatttaattctcaccacaaggctacatgtaaatacatctgtatccattttacggacataaagttggaggttcaaagatgctaagttaacttgctcaagggcacacacagctagctcaaaggagcagctgggtttccacactacaatcaacctttccaaactcagtctttcaaaagtgtacactttgttgcctttggccatgtgtggaaattactttgtggcagaatcctgtacatccaaagtttacaactttccaatcagaatatttataatctccaaatacatctgtatttttttcttgttctttgtcatgaaataaattgactggaacttcaattctttcttaatccatccaagagactatctgtgaaagaaaaaaaaaatgacctgaaagaaaaggaaggacatcctgcaggtgcacaaaccacttaagcccccaaaacaaatccatcattacaaaacagatagatgagaggtatctgcattataaaaagatccatttaaaatgggccttgatttacatactccttttccaaactcagaaagcagttcttatggctaaagccaaacatgtttgctactgccaaaacggtctcccacacaagacatttctctcctcagcagattgcattaaaatgctttcatacgcatagcatgatttcatagcggtggaaaaaagatgggatcaataccacatggtctctgccctctaagatgctcaaaaattttaagcccaacacagtaaacaagggagagaggcaggcacctaatgaacatgaaatacataaagtgcatcgcaggggtttcaggcttaaccaggaccagcttgaaaaagagaactctttagtgtgtcaaaacagagaagatgaaattcaggtgtttcctgacaaacaaattaaggtaataggaacatggagaagaacaaatttgtaaagaagtataaaagagacaagccaaaagcatactacgctgaacgtaaggcatctatgtagaggtaagcaaaccgaccccccatcctggaagcaagactggcccatgtgaaggtttacagcagacaaactgcaggatgcaccaagcactgaggcacaatgaggaaggaggcacacgagggacccagggacagtcaccttagtggcctggtataatcactgagcagatgcagatgtaagactgtaactagggacctcagtgttagaaatcacccacattctttttccttcttccctcccctctcaactctttattccttccctctctagacactcccccttaggcaatccatgcttatctacttaggctcttaagaaatcccacaggctaatcttgaaacaaaccaggaacagagtccccactgcaaaatcctcatgattaggaggagtcataattagtccaccaccactgagccaaagtcaagataatgccaattagaccttcagacacctgagagagccactgaacaagacacacagatcctgcaccacttctgcacgtctcccatacctttctccctttgaaagccctacggtaaatttttaaattgaagatggtactttagaatactagtttgccatcttctcagtttgctggctcccattaaaaatgcttttccttccaccaatccttgcctcttgtgttctggctttcaagtggcaagcagctgaacctgggttcggttacaggccttctagagtaatggccaggattgaaacctagcaactccttgtgtcccaggaggatccatacttccttggcatgataacatctggcctttgtaaaagtaactagaagggcaagaaaccttttgaaccataatacccagagattaatacaacacaccaactcagcagccttgaaagtattcttgcactataaaactaacagatatggataaccccaaccaccaaaaagctaaacccaagatgactacatcaggcagggcttacgattttctgagacctcctttacacagctgtaaaaacaagtacctcaatcctctttctgccccccgaccaagctaagctgctattatgagtggacaaagtgttaataactaccacagtaaatggggaaaaactactgcaagtgttaacaaaccttatttttaactgagtagcaactgcaaaattacacatgccttgtgaatgcacgtacatacctacgtccttcgcatacaatatggtgacatcaagttagaaaaggagtgaaagagggagggaagctgagtcattaagaagggaatattgggtagcatcacatgatcaggtgtttcaataaaaacatatttcaccttatgtgtactgatcataaagtatctgctatagaccgatatgtacaacccttccaccggggggaaaatgtccactgtaattccttttatatcaaaaagaaagagcagaattaaattagaggtatttttagcaaagacaaaggaagtaaatttccaaaggacatccatcgtccccagtcgacacaaggattaagtataaataacgtgatttttcttctctttgtacaggacatgttgcttagtttatagttaatgaagaggtagttaatcaagagggtaggaggaacatttttctttctttcctctaaacttaaaatagtcacacacagcactgatttttacatgcttaggaaaaattccaaaacagactgatggtgtttgggctggtgggggtataaatgctgagtataaaggaaacctatttaaatactacagacacagcttcacaaacctcaagaacactctctctgaagcaataaagaaaaggaatcctaatggaacacagtccccagaggaaattgagctgtacatggttaaagttgtaaaggctatgggtcagatgggaaccatggctacgaattaagtcaaagaggtaccctgacagaaataagtatcaattttgtttttgctcagggacagcttatgctacagcaaaccactctgagaccacagggcaacttgcccaccaattaacagatggctcctaaagagaagtacaaaatggtgcagctcctacgattgccacattcatatcacacataagcatttcttcccaaatcacctcatccaaaagttgaagtgattagctattgtaatcctccaaatttaaaattcacggatactttgaggaagattttgctaaaaagattttacctagacaatgattcattaggacacaaaagtaatgtggcaccatccacatcagcatggtatagtaaacgcattatcctgccgaatgagcagagcacagaggcttgtcttgtcttttaccactgactttaaagtatattaaaaacgaactatctaaatcatatacccagcaacttagtacatctgaccattgctgctaattctggatacatctttcctatgaaacaggaaaaacctaaacacaaaaataattttaacatattaccattttatcatctcaagtactcttaaatgtataacagggtagagggttaaaaaaatcttattcaacaacacttcaattttaattcatcttaaaaacttttaatgtgatgctttctttaatctgctgttactgaagttactcgatttgcttattcacatatctgagacccactcttggggaaggcgctatgtttttatggcaccagattaaacaatatgaaggaccatctgatgtgggaagtaacttctatacacagagcttctcagctatttgggccacattacatgcccacttggcaaacacattttaagattaaggctaagacaagtggatcagaagaatccatcttattaccacaaaggggtccctaaggaaaaggaggttaggagtttaaggcctccagctaactagccttatgaatttgagattgggatctcatctgtgggaaaagaaactgcactaaaggtactctctgatgctcgcccccacctattattctaccgtctccaccttaagtttcacaaatagattctgatgtgcgtgttagaatcactcttgttaaaagaggttcctacaatgtagaatgccatacaaaatgttaggtattcaattacaagtacaccactcgaagaaatgaatgttttactaaataactagtttttcagctcattccaatattcaatagcctatgctgtcaagagttttcctattttgttgctgaaaacttcttccttgctatttctaatgaaggaataaaatagttatatattataaactaatctcctttattcagggaaaaactttaaatatgtatgctgccagatcacttactagcccctgtacccaaacagaatataacctattaagtgcttattctagttatcctaattgacaacaacattattaaggattctacttagattataaactttatttttctcaagcaagagtactttctagcaagaaaacatatatatactgaaatggatcttaacacaaaagcctactatactattttgggcttctttatccttctcgcgcaccccccacgaaaaaaaataaaaataaaaataataattaaatctaatagtaaaggaattagaacttttacctcattattccctacaaagctaatttgttccttcatttgcactctctgtcattgtaatctatgacttaaagaaaatgaagcaaaaaaattcttttaaaaataaacaaaccaaaaaaacaggctgggcacagtggctcccaaataccagcacttcgggagtctgaggctagaggatcacttaagctcaggagctcaagactagcctaggcaacaatagggagaacctgtctctacaaaatatataaattagctgggcataatggcacatgtctgcggtcccagctactcgggaggccaaggtgggaagatcacttgagcttgggagcttgaggcttcagtgagctgtgatcacaccaccacactccatcctgggcagtgacagagcaagactctgtctcaagaaacaaataaaatacaaatcaaataaccaggaactatggtagatttttacaatccccaaagaagaatgttttctgaatgtataatctacagccaaattaagatattatacaaagattttctgtgtaatcctctataacctggtattatcttggccaggtcattcccctgccctacccaccaccatcttttcactttaagctacctgaacagatatcccattcaaatcctttaggtgtacacaaacatcttaataggttgcaaagaagaacacaaaattgactagattcttttttgaacaattacatttacaattcaccatcaatgacttacttgctgggaaaaaaaacatactgtaataaaggtaaaactagacttgcatcttttcaaggagaaccaaagactgtccaaaaacctaatgatgacatatactacttatcccataggacacagaaatataatgcctgtaagcatacacatgtccctacatggctggaaaccaaaagcgttaactgaagggttttaaagaaatgaccactaaataagcagaggagataaatgtaggtcattcagaggcaaatctgttttaccacaagatatatggctctccttagctactaaaagcaatgggagtcaccaaacattactgacctctgaagactaaaagctagagatgaaacattcaaaaagacctgctgtgtgaatgctactgctagtagtcatctcagtcattcttcaggttgttcttgctcacactcagtgagcaaagtagtgcccaagaaacataatcaaaagggggaggaagtcacaagagatgacttggaagggaggatcggtatcttcactgcacctactattttcaaaattaaattcaaactttgctttcctccaacactaacaaagtgacacaaatatgagtaaattgtttgaaaggcactgacaagtgactttatttacaaaatatgcatacatacatacacacctctcaaaacaaactcctttaccaatagctatggcaagttcacaacaggggcttctaaccaattacaaaagttattctcttataggtcaaattgagaccaatacaaaattaataagcttacttttgagttaaaaaacactgatagaaaaagataaaaaatatgaattacataaatattgtttcaatggagttctagattgtacactgactctacctaactggcacaaagaaacacactggaagagtcacagagcgttttcagaatgagtaagggctgggaaccagacttcaaggagttaagtagtaggaagtaaaactacccccacctcagaacagagaggtgagtcatcatcaccatcttatccttctatcacttccttgagaccctaggtcctgagataaaatgcctaattgactttacttcggttccttactggctgcttgcctataggcaggcagaaagagagaggacccacccaactggcttctggaattagctttttcccatcagcaatatactaagaaagagaattccccaatacagaaggaccctaatgaaatgtaagactgagacaagtttgtcttggatccacgaacatccttagaagtctttccatgtaaactgaaaaagaaaaaaaaaaaaaaaagcctctctcatttctgttcaaataaatgactgcatccaatattaatcatcaaatgaaataatcaacaaatcattagtggaccagactatactttacatcttcgctcaacaaaacaagcaccaatttagaacatcctgcattccaccttcacagtatgacaattccctccttctctacctcccttgaaccatgaggtataccacaagaagttccactagccgagtacagtagtcctccaccccctaccttatccttgggggttacaagaccctcagtggataactgaaaccacagatagtactgaatccaacataatatacactacttttttttttccgatctgttaagatggattctaagtgattaaaggacagggaacatgtaccagccatggataatgtggacaaagggatgattcacatcctgggcaggaaggtgcaaaatttaatcacgatactctgaatggtgagcaactcaaaacttatggattgtttatttctgggattttccatttaatattttaacactatggttgaccaccagttaactaaactgcagaaagcgaaactgttgataatgggaggactacggtatttcatggcacaggctctcttcaacagatagtcaccacttgaaatcaagaacttaacactggctgatattctccagcacacccaaagctcagacaaagactactgaacaactggttaagcttgagtcatctttaatcaagacaagaccttacagctccagaggtagaagaccttcctcatctcaatcagaggcttttggaaactccctacaaacatgagtgcaaagtaggcagtggggataagtctacacaaagcttgcattaagacttacccatgaagtattcacctttttcattattttaaactcttacaacccaggggaggctttctgttaagccccaacacaggaaattgcttttcagttgtcaatagccaacgtctgaaaataaatccagtcactaagtgtggaatgatgtacttgcagccaacatgcatttggctgatgccaacagagaaggcaggaggccaagatataagacctaaatttttttttttaaaaaaaggactgttctactcagtaacagaatctgaaataatgcaaaggcagaaataggccacaaaccacctgcctctctagcttcaacatacatcagcatctgtctcccaaggttgcttcagaaagatatttaagttttctctaactacaataattgttccagtggtctaaaaaaaagaaatggctctgtcctgtgggtttctggttgggtggttgactgttatattgatggggggcttccttgaggggtagggggaaagagtactagggaagggggagaaaaaaatggaagaactaaaactacagaagagaatttctaactcgtcgctctttgactctgattgaggaatggctttctgccaagatttccttcaagtgctcagcagagaatgaagtgaggtaacgagaagtagtctggggatgttacacactgtgtcctgtgtcccaagaccccacacggatgtttgtccctggatgctctgactctctgggagaaaagagtagaaaagtatgaaggcagagaagacttccagggagcaaaactacttgggttcttctttctgacccactgtacatacaccaactgcctcttcctccaggtaacttgccaagatggggagtgataagagattgaaggcaattttcaaaagaataaaacaagcttgaaaccaggcagaacaactgcaaagggggtaagatgaagtccctgcaagtagtcagcaatctggcaaaatattgcacaaattcagtattttaattggacgtttcttttacggggaatgtggcatgaactaaatttgaagccaggctacttatttcagggggaggggttggtccctaaagccacttggagaggaagagaaataaaacatacagaagagtctacagcccaaggggaaaaaaactagtatctcctgaaaacaattatcataatttactttcaaaatactttggtatatcaaatgttgtatgatttcatttatatggggtaccgagaataggcaaattcatagagacacagaaaatataatggttaccaaaggctgggagcaaaggaggtgggtgaggagttactgtttgatggttacagagtttctatctgggatgatgacaaggtactggaaatggataagggtgacggctgcataatactgtgaatgtgcttaatgtcactgaactgtaaacttgaaaaggttcaaatgataaattttatgttatattttgccacaataaaaacatttctttttaaagtttagaattaatctgatgacacgtgtgcaccagccatttaagctttaattctgggtggtcatctaacatactatcattaatgcacaatccaggattagttaactagtataatacaagtaggctaaaattcaagtgactagtgtaagcctacatactatccatacctaaatcaacaaccaattctctgctgattcacctaatggatgtcaaaatagggttttgttctgtaagccagttatttgttaattagcataacgagtgttagaaatggagtcttaccggtaaaattaaaggagttcaagatacgcagatgggctaaattagtttagagacacttcccaccttcgtataaacagggcacaaaatccaaggtggcataatccaaggtggttatatctttatggagagaacccctaaatgttaaatggtcctgggtttcagtctttgtttaaagggatttctttttgcatgatgcaaagtgagggtgcagaacgtgacttttgggatattgttagcctccggtgaacatttcatttaaagtgtgttcaaagcacttaaaaaagaagagagaagtgggactttaccaagctttcagaaaaggcttctccatcaatttggtcctgcttgctagatagaggtttctatgtgtggtgggatctggcctgagaccttctttcattataatctatagagcaactaacgctcacccttcctcctttggtgcctactaacaactacgcaaaattacctaagagctgttattcactatactaacaggtccatttaataaacccagtctcaaggagtcactggtcatgaacacagtggcctccaagggtactgtcttaaaaaaggaaaaaaaaaaaaaagactctttaaaagtcggttgtccaactataaaggctaggaaagaatattagacatcctccttactttgatggctatatccaaatatattgttttctataagcattcagagaactaaaatatcaaatagagtaagaaactaaccccagaagattccatattctacttttaagtagcacatcaggactagctttgtatgttctagagctggggatataatggaatgttatcacgcctttttgcaaaggctcccaatttccagcacttaaaaaaatacacatattgatataaaacacagtaacaaatcggtattaacaattctgtattttaatcctattccaatatgtataaaagggcttacccccataaaaaaaggacaacaaataataaagaatataaaggtctaaaaacaaacctggtataacattgttagattttaagatattagatcccaaatcattctacttgagaaggtagtacactgtctgcaccatataatggcaaaatcacttggcaccatgtttaaaaagagctaacctaatactcaggttcacaaaagaaaaaaaagacaattttagaggcaggatttgggaagtcatttaggagagcccttgtctacatgagaagatgtcaattgatttgatacaccatcagtctctcatttatattcaaaatgtttagatacatttaaagtagaataagagcaaactacaattcatttaaatggaatgaaaaaagctcccatggcttacttagtaccagggttaggaaaaaggattcgtacgacagtacccttggaggcaactccttaagactggatttaaagcattaaaatgtgaggaaataaaactgttctctcaggctccagtgaccttaaaaacagtgcagtgattctgatttaccagtttacacacagctatgcctcccttaaactttactttaaaaggaggatttgactttctcagtattaagtccaaaggtcaaacaggttgtaaagagtcaagggccccatcagatctactctacaaggtaataaacattcaagtctatcatccctcaccaagaaatgcaaatttttgttgagctagaggatgggagttgggggtggtggatacaggacttgtacgccatacacattttccctacaaaatcaaagcagtatgtacaaaacagagttccaacaaaaagtacaatgatgagaaaagaactcattaagagctaaaaataaactctaattcacaatatgcataaggatttaacaaaaaaggaaaacaagatgtaaaattgcatctgctaagttaaccataccctcatggaaactgccccctcccccatacacacaaactgaaatctgtaaagtctgtgatgactgaatgaagaaatgctttagatgttttcaatgaatatttcaatggaaaagaaaacaaagggatagtaatttttttcctcagccttctgatctgctaacactgcaggaatattaggtttttgaacatcccaaaacacaggtctctgtatatctagacttgaacatcatctttgataaaatgagactatttagtatagtatttacgttttatattaaacggatactcatcttaaggaagatgatgtcaataaaagtaaaaataagccgcagttggtttttatctaaccaacacttcatggctcaatttaacaacttgctgaccttcgaaagcccagtaatagctcactggaaagctcacttgagagcaccttcatattttaagtcaagctaattcattctgaaacattcacacaataccacatagagcaataattccacactccggtgctctagttcataaaggctggtgtaatatcattaatcatcattctgggctcccaagtcctgcctcgcactttctattcttactttgttccacccctggaaaatcaattatgttggtcaaatcacctagaaagcaaaggatggaggatgagctttgcattcttcccacatcatgacaaactccaagaaatctaggacaacagatctacttcaagatgtttttcaaaaactactttttacctatggggggaaaaacaaaagtctgcaactgtcacgtaactgaatgggtattaactggtaagaagaggacaggaaagagagacagtacccctgtgtgctaggtactttatgaaagaaactgacgttcagagtcaaaaagcacacacaggacacaacacaaattgagtggctaggctggaattggaacccaagtgtaacaatgttctaagctaaaagctctaagattagtgtccagtaggccacctccctagcaggaggaagcaaaggtattttgattcaaacttaatcccaagaacttgatcccaaactaagtaacaaacctagtgtacacaggggtttagtaaatcctactaccacttaagaaacttttttttgttttttttttttgagatagagtctccctctgtcatccaggctggagtgcagtggctcactgcaacctccgcctcccgggttgaagcgattctcctgtctcagcctcctgaagagctgggattacaggcacccagcaccaagtctagctaatttttgtatttttagtagagacggggtttcaccatgttggccaggctggccttgatctcctgatgtcagatgatctgcccaccttggcctcccaaagtgctggaattacaggcatgagccaccatacccagccaaggaactcttataaacacagcttaaatacttctgtcttgcttttttcccccttaaaggaggcataaggtaaatctttgttctaatttagaacaatacagaatgatcacccctcgattacataaagatgatatatggtgtcagaaattactgagtggagtctgaaaagatggttttaactgcgaatctgtttcttcacaacacttagagcagcaaatgctactctgtgatttacagcccctcaaaaaatatttgattacatttcccaacaccaataaaaggggcatccaagggttttgaaatattgacaatctaaaactttaaagagccaaaacaaataccttaaggactaaaacatgctaattaagccactgtatagacctgacaaatcgaatgacactcaaataaaatgccagaaaatatctgttaaagttgaccttttgagctggaaaagcacactctgagggtttccacagctctcaacgttcagtagcagcagtgtactcagctgaaagtcaattaacttagaacaagctcaaaagaagttggcaaattttgaagcacagttttagctccaataatcaactattctgttcaggaatatttgaaaggaaatgttccaacaggtacagaataaaagtgcttcggtctattctgaatttaaacaaagttaaaaaaaaaataaaaggctggtggccaaagctgtgtcatagttaaggtagtgaaatagaatgaaaactgtcaaaaacaggttgattttgtactacatcataaaaatggggggtataaatcattttcataccaaagaaacagaattttaaaattctataaactacaaaaaaaagaagcaacaagttcatatcacaatttaactgttttttatcttctaactgaactatttccattttagttcaccatcttcctcatcgacattttccatcattcctacgacaagcgcttaaattgagaatggtgtctcttctataccaccaatctcctgatgcaaagtaaacaaagactaccccccagaaaaggtctggaatagcaaacagcacacgtgcactcttatgctgaattataaaggggcaaatgttacaagagaatttcaactgtaattttattttctatgaatttgaatatgtttacaaagtttgtgttttctatcaaaccagcaaagcaacaaagagaaaggttactgaagactattcctaatctactggtaaggcaaatacggctattctaaaagttcctctgataagggctaggaaagcacaaaatcaaaactcctaaacctcatttacaccataggttcaactttattttcccagtaaacactctaagacagctgttggaaaactgtataactgtctcgtgggagtgacacatatttttttttacattttattctaacggaacaaaataccaagtaacacaaatatcaatatcaggaaatcagagaaacaaatctggatgattaatgaattactagagaagaatattgtttcatacttttctgtatcctcaaatagatgtttcttcatcctagcaactagccattaaaggcttcattaccacaggttatctaaagaagcagctctttgatttatgaagagatgttaactgggaattaacttactgaatggtgaaaaggtccagatttgccaccccaaaatattccactttggcattaagttttttttttttattatttttttgtgaaatggagtcttgctctgtcacacaggctgaaatgcaagtgcggtggcacgatctcagttcactgcaacctctgcctcctgggttcaagcaattctcccacctcagccttgtgagtacctgggactacaggcgtgcagcaccaccacacctggctaatttttctattttcagtacaatcagggtttcaccatgttggccatggttggtcttgaattcctgacctccggtgattcgcctgcattggccttccaaagtgctgagaatacaggcatgaatcactgcgcctggctggcatcaagtattattttaggctgaggaaaataagaagtcaacagatgcaagatgagttctctgccctccccttttctccctaaaagcagagtataaatttcccatgggaagatgtctctctgtcctgtaccagttcagaagtaagcgactcattacttgagacagtcaacatcagattgtttatgcatacagttctgtataaaccaaccttgttaaaagtgcccttatcttgtcattacttacccctacatattttctgaacgcttccccatgatttcctattccgcaaagtccaaacctttcctttgttaaaatggtatataagccccccaaccctgaccactttagttttataatacttttctgtcaactcccaaacacaaaatacgagcaaaaattgtgtgccatttctccaattaatttccaagtccccaggtactaaacaaaagaggacagaagttgtttttcctaacaatgataaagaactgtactgtatttgatttcttaaaatgttacaaatttctagtttcatcatcctgtaatctttccactaaactaatcaaggctgacactgaaaattgttctataaaaatacccaggttcaagtaaaaagtgaacctagaagaataaatgttaaagactttctccaaaattttatatgaagcttctacagtgataacaccaaattttttaaatgactgcaagacctttggcaaagaaacaagatataatgaaaaaataattaagtttaaagatacatcaatgaagatataaataaagtttctccattaccttttgcctatgagagatgttccaaaaatagaggttccacaaacttgacacaaatttcattttatacaaacttgggcactaaaatctaaaaatagattcaaatgtactgtattccacagttaacgcactgcggaccaaagcatttacccctgtgcaggcatctcctttcctacagacctaagaacacacacaacctttctgccatctttctaattaaatagcatacagagtttgcaaagtgaggtgtttattaagttaccacccacccaaccaccctgctgtttccaactactggtctgcaagaatcagaattcttgatctcttgatactatggacatttcacatgctcactgtacaactgtaactgacatacaaaatcacattttcaaattaatgttcatcaaaacagctttgtgttcactgtgattgactcataggaaataagtgctattaaatttgaaggttcccattagtctaataaaataccacttatctgtttcaatcctgaggagctaagattgtatttgtttaaaaagaagagaatcctatgccattaaaatagtttggaaatcacattattttgatagaataaagaaggatcaaaactagctgtaaaattctcagcaagcagagacacaagataaacctagctaagaacactcatattaataaaaaatattttaagatactagccctaaggcgtgctggggcatggcaggagccttatcatgcaaggcactacctactcagaggtaatcaacatctctttgggccctctggaatttatatttgggtttttgttttttccccttttgtcaaagtttctagttagcagctgatgaggtcagtacaagacctacctcaaacaactgagagtaatggtgaaatactcattacctgaggtcttccaccaactactcctctagccattcttttagaagaaaggaaaaataacagtgaaagaacaatctaccctggagtttcaaaaacctaattacacttaaacacacacacacacacatgctcgcacacgtgctttcagcaacatatcagatcagtaaggacacagcctagtgacgtaaactcaacatgtctagttctgaaagctaggaattaactcagagaccaatgctgaagaggggacagcactttaaacttaaactttccaaagaattaagtactgcaattgttaacacctcttccataacgccctaaatctagaattcaggtaaacctggaaatccctggttcaatctccctacaaaatgtttaagacattgataactcctagctaacgagtaccttccaggtccccactacagattctgattcagtaggcctggacagagcccaggaccgtgcatttctagcactcattacaagtgattccaatgcgggaatcctgtgaccatacttcatgagacacagtctgattcccaaaacttttttgggcttcaagatcacctgggaagctctctgacaacagattccaaaactcccttaggtgagtaggtgaggatgtagagccaaatttgggtaccaccgggctagaatatcaagttcacaaccatagattataatgtttctagagaagcacagatgttcttgttcatttggtgtattcgtcagtccttactgtcaaaaaccttccattctccttccagagaagacacactcgccagaagatgccctctggataactctgtaaaaatcacacatctctctataaattcatcagttggccatttgcttcatctttaaagagtgagctcttgcctccaacaagtggcaaagaggaaacatccaggtaaagcataagataatcagaattctggtccctactctaccgcttaatagctctgtggccttgaactagtcatttcacaaacctgggcctctcatcacctatgatgtttggggcaaagaagggagagggttggttaaggtcacctctagggcttttctgactgtaacactttattactcattccttgcatcataaaatccatttcgttcatctagaatgcagcatcagcaggtgtcaaggactcccaagtgcatttaaaaacgcaaagggatggactaaagtcagctaagctgtacaagcagcagaagcttctcatgatgaatgcctatagataggaaacaggctgaagcatacagctgggcagaagcccaaagagacggacctgacaaataacataataaatagaacttagtctagagagaagattattgtatttgctactgaagacatttcttaatgtacttccctaatcctcactcgatcaaaatagtgacattaatttgctaacactgacacagtctaaaagttatacactctcttcaaggacttaagaagcacacactttcctaactagatatttttgttccttagatatagtttcctgattcagcattaagaaagatttaagaaaagggaaaaggaaagatttcaaatcttcctgtagagtgactccagagttttcctgtaacccaattaacgcacatgctcctacaaaatcggaatacagaaatgggtcccaactgcttcccaggaggtagaataagctggataattagagaaggaccaaagaactctggtctgtccctaaaatacgtactgagaaactgcacaagacgggtaatgctacacaccacaggacagggtccaaagctccacaaattctttcaaaaccttgctagagatacattagtactacctcttacgaagtatgcctacttttcaaagtacaaccactcagaacccagatttagatactaccattttctagactattttactcaatagaagtattcagtaagaaactcagaaaaaaaaatatcctaaagcagtttatgcttaagttaaatgagtgagatccttctaaaagccattttaacccatattacaaatatgtcagtggtccaaatcaaaccaagattaccagaagttgagatgcctagtgttcagatttacctactccacttttgaatttattatcatatatgtttcttttaggaatcatgctcatatgttattgatgtgaacaggttaaactggtctgataaccagttaacaacaaatgatttcaaaagcttttatagcaccatgttcagtgtaatctactgtcagggagagatactcactcttcccacagtccccaaataggctctatgatcaaataaggccggggaactataattcaaacaggttttctttactgctggatttttcatagttcttaatacagtgattatcgagtatggatcttaaataaagaactacagagtgcagcacttcctaaacttgtctgtcaatataatacttatgttaagaaataattactagtatctcaccaaatgaaggttgaaaaacatctttcaatcttatacacactatcgtgggaaggcaaattaatacaccaaatacactatgaaaaatggtatgaaagttcctcaaaaaattaaaaacagaactaccgtatgatccagcatccccactactgcatgttaacccaaaagaaatgaaatcaatttgtcaaaagggatgcacgcatatccatatttattgcagcaatgtttacaacagccaaaatatggactcaacccaaatgtccatcaaccaataaatggataaagaaaatatgctatatatacaaaatgaaataccattcagccacaaaaaagaatgaaattctgtcatttccagaaacatgggtcaacttagaggacactatgttaagtgaggtgagacagccaaataccacacgatctcataggtagaatcgaaaaatgctgatctcattggaggcgagagcagaatagtgggtaccagagggtggagaagagaggaggaaggaaggagggggccagatggttaatgagtacagggtcactgttaaaagaaataagttctggtgtgctattccacagaagggtgactatggttagcaatattgtatagtatacttccaaatagctagaagagaggattttgaacactctcaaagaaattatgaatgtttgagatttggaaatgctataataccctgcttgatcattacacaatgtatatagcatcaaaacatctcactgtactccacaaatttgttcaattatgtgttaactatatacaaatatatactatatatagtagtgtacacgtaatatatatgtgtatacatcatatatagtattatatatatatatatatatatatatatatatatataatgtatagaaacgtcttacatctttagaaacatctttcaatactcatgaccattgtggaatttcttggggactctacttgcttaccaaatatttttaatagaaattttaccacagtggaaatctccattacatccttcccctcaagccactgaaaagacaacaggcaggggtcagaggtgaaggaaatggatgagaaatatttacacagttttttagtatctaggtatgtattaaagaatacccatgtgttgtgcttctattaccaccgtctaccacactaaagttagagaggcaaaggaggtgaagataaagaactcaaatttatcccattttgccacataacagctctaaagattcacaaaagagtaagattaattcaagattgactagaggtgagacgtgaggatctgtaagatgtctcctgtggcagatgcctaatatgaaagatgtatgatttgtctaatattttcatcttataaaatgataaaatgtatcatttcgtaacagtttcataacaaaacatgacttttgtgctctgttcatgcatctttctttttaatagtaaggggagctctactaagcaatcagaaattgcatcatttgtgtcatagccctcaagtcatttatcatatttttatcttttatattaaaaaggttgcaaaatccacatgtcaggggtgttgttttactttaaaaacaaaagataacatgtttaaaacatgttaaaaagatgtttaaaaacatcacgacagagacgtaagagcagccttttgttcttcacctttttcaacttattaaaaacactataaatttcacatatgcttatcacactcattttggaaaagaaattgaaaaatctcatccatctgattatcagtgttcagaaacataagaaccaccttcctaatatcatagtgaacatttaagcaacataattaaaatataatggccgtttgctatggatcaatgacaatcagtttgtacttagctttttaacttgatttcagtaagttgtctctgtgaatctcaatctgtagcttgaggaaatatgattatgagccaagtccaggggctggctctagaactcacttgcagatcttggagagaatgagccctaacgattaacggaatagctcaaagtcccatgtatgaaaaagtcaaaagtgaacttagaaatggcccagtgttaccccctttttctctgccttttaccttattttgccaatggaaaccagaagtctagggctgacttatccaatgtcacatgactaggtgagagttcagactcctggtctcattcttcacactgcctttaagtatcttttactcatttcaaatattccattttatatttttggttataagctttgtaaagcaatttggtatacactatcaatcaaatttaattaacatgaaaagtccacagagtctgtctaccttcgtatatttttagtgtttaacttcatatgtatgtctaacttcatgtatttttagtgtttgaaaacaactcctgcaggaagcattaacccttctatcccaagaacgtgctctttaaattaggttttggtttactctaaaaatttagtcaaatcttaaaaaatactaaggagattttcacctaatattcaaaatgtactataattaaggctttatctttataacaagaaggacaatcatataccatgtcctttccttgttaaggaacggaacataagatctcatcacgcttggtattatatcagtgaaaatgtttatacactgacaatgtgaacattaccatttattttatcatatataagcaaaatgattatattaacataaggaaaacacattttaagattttttcccctctcccaaacacatattgtatctcactgttgaaatgctaacttaaatacactcagggtactaaaagataaaagttaacatgacactggctatcccagatacatatacttttagaagattttccaaagatcctgtccagatcagagtacattaaagtccagttaaaatatatactgcccccaaaatagtttatgatttaaaaagaaaattttaaactaagtttcatattgctgatgtaataacagagagaaaatctagatatgtaaaattgcagcagtgaattatttacaagcagtaatcttattattttctcctatcttgagacacgatccgttaaatataaatcatctacataaaactgcttacctgttattttgtctcttacaagcttacaggactctatttcaccaatgctcccaaagagactctttagttcctcctgtgtcatgttctgaggaaggtagttgactattaagttggtcttgctgtcttctgtgttcccagagtcaactggtgacgaacagttgttgtttatggtggttggaccattggctgtgttattgcaagttggcccattagacagttgtgtttccatggcagcaattacctgctaaaaacagagaaaacaagaaatgtcagaattcatatttcacaacctattagagactccatccaagaatttaaacacttgtcactaaacacaagtcgttctaatgaaattacaacaatgcttcaacaaaaagtgtaatacctacactaattttcacttcatattaacctattcatcttaaggttacaactatattttcacatacatattccatacatgcatataagcacaatttaaatcttaaacattttctagaatcacattctgggtctattcacatatccttactcacctgcagtgtccacagatgagaaaatcaagtaccaaagggcacagaattgaaccctaactaaaaatcatactagaaaataaaagtgcttaacatgctacaaaaatgaacaaaaaaatgacctacctaactctgaagagattttcagttatcctaagaggttcaatattctaaaactgacagatagccattaacttaaaaatcaaagagcaagagtacttttaaaaatataaatttgtcaacatgtactgttttggttacatattgaaaacgtttttgatggacaatatcttatctctaccattggtaagaaaaaaacagatgctatattttagggagtggaaaggaactaactgtaaggtaacttgggaatgagctatgaatactttgtctaactggtagaatctaataggacactcctgtcaaccttggcagctaaaaattaccaacaaggtgactgatctacaacatcaaaataaaatccccaaacacttcgatatggtgtttctccttgactctgctttttaatgagaaaaaagaaaacctatccagtcaatgaaaacaacaatgtaaatatatcaacttttgcaaacagaccagcccaaggaattctcgtctgagcacataagcctgttgaaaatgcaagtaatagggtatctataaactccaaacaccagataaagaacagaattggggaaaatggcctcaaactgttcaggctactctacaaatcacttattaagcagtattaaatctagtttcctaaaaccaatcctatgcaaaagagtcacaaaccacagccccaaattttccaaaatcattttccactaactacctatctttggacagccaagactgtggtggaatctaaaaatcaacgcatcactgaaaggattatccttcatattgcatacatctctcacctccacaaagaactgcttctcaaaactgacaattctgaattgacgggatgctagttttagggaagctttaacatagaaaaggcaaagaacttgaggcaaagaaaaaaagcaaagtaaagggaaagagggttacaaggaaagagaaaaaactgtcttttaaaacacatattgcctaagaaaaataaaagggcacattagcagataaacatataggaagaaatctctactgccaggagatgtttacaaaagaaggcagtgttggacatattgagactggtcagactgaacaagaatcagtgctgtcatgataaaaaaacatgaggcaaaatccagaatagcttttgaaatatccaacaacctgtaacccctctgtgacttcatttccttgtcaaagaagtgggaatttattctacaagctgcaagctgtttctctacgtaagctaagttttctcagggaatacttaaagggatgaaggaaaataaacctttggaaatctgtatttaaaaatcttaaataattcaagatatgggttttattataattagcaaatctatttgaatttgaaaagggaagtttcagatttcctaattaaacataactgttctggtttgtagaatattagctgtgggtcactcttttcacagcaaaaattcttctggggttaacccttgcccagcagttatggaaacaatgagctacaagattaaagtggccaaagacacttaaatcactactgaaaagtttggatgggtgtagaaactacaagagacccgaatgggagattcggactaaagctcattgggatagcatttgaaatacaaagtgttcattgactgaaatcagcaagatttagaaaggacaacaaacactcctcacttaattgcacatttatttccatgttcaggtggcaagaatgagctcctaagccaacattcaagtgaacagctgcagtaggctgtgtgcgctgaaaattacagcatctctctgctataggaccatctgctcagaataaaatgatactaatgtgctatattttacaaataatgcatattccattgataggctcaacacaactgttcacagaatgcaaactctttcaacagttactgggcaaataattttcagccagatttacaatttcaactttttttttggagcataaagaattgtaaataacttcaaaatttagtaaccaaaaaaatacatagtaaacagaatgtatagaattacggtaacttagtattcagaccataccaaaactttttttgtttttttaaaaaagcttgtcactcttttgagtctgcgctaaatcctaatttagattgtaaaaaaattacatacgagagcatggttctgatgctacatacaccactacagttaaaattgcaatgtgctttaagtcctaatgatggccataccacaataggttaaatgtaagaataattagtatgccaaatgaaagattcaagtgtttggtatggcctcagcactcctccaacatgctaaaaaaaagtagcctacagaatttaagaaaaatcccacagaccccggtccaaggctctgctgcccacgaaccacttctaagcagagaagccacatcacacagtctgactgccatgttagtttggagttgccgtctgcaatatggacacaaaaagtaccgtatgttagatgagcaagataatgcaacaaatcagtttgtacaaaatttacagtgattgtattgatattcccagcacgtccatgcagtgtggcttaattgaaattgaggcaattccaatctaatctttccaaattcatttcaacatgtagttttcttgcacaaatataagcatttttaattaagagcctgattttaaaacagtattaactagttatcttggcatctattctgaagaactaatgtaaaccacacctcaaaaatttaaaaaataaagtaaaataaagcaaaatactgcaggctgtcttatctcttaaggatgtgggagaagggaggaaatgtgaatgaaattttatagtgggaaaaagtcatcatgcaattcctaagtgattggtttgcataaaagcactctttccccaaaatatcagaaagacattaagagaagctatatttgcccacactgttacattatactataaatgatccttaatcctgggacttaaaattaaaagtgaatcgaaaccctgtgaggttattttgccactacagtcaaacggtttctaacagtttcaatgagaattgctcacatatactaagaggcagtaaaccagcatctttcaattgaaataattggaccgataaataggattgtttggagtaatgctcgcataggatgtcagctttgtccctgaacgaaatcaagtgaacattttttaatatgtaaattgtaaacccagcacgatttgaaattagtgctgctatgaggcctccaatatagttaatgggccatttaccacttattgaaacttgcccaaataccaaacagagccatgatattggcacaaaagccaaagtttactttttttgccatatatgcagatgcttcaaatggtcaatataatcagaaaacttagtttctaaaaatagacagtgaataacagaagaggtccaaaaatgtcttttacttattgataattataaaaattttatcctgagaggcaatcctggctgtgatttactcttgatattagcaatgccgccagtaacgatggattccactttctggcatctatcaaaaaggattaacatacttttttacaggaagccatgaaaatattttactcttcttccgttctcccactgtaacaagagattttggtctgaccctatgttatttttcaaaaaactacttatagtttaactgaacctgtgaaaaagtgctttacacccatgaaagatttttcataagaacccaactgtagttaagactacatgagcaggaccacacccagcagggtaaagcaggcataaatgtatgtcctgaataccttcaggagttcaatctaaacattgctcactacataaaacagattttaatttaactgcctcagtcccttctatttcataggaggtggacactaatgagctaatctattgacacccctctttctgaaagccccagggaggtgaacaatcactttattgcaccaactagataggaaggctgtgtatggaaaatgattctactgcacttttacatttcaagcaccccagacagtcttctccgcttgaggcagacacatacctttatgggaagttataaataagttgctcacatggcccttacctttatgctggccaacaattcagttactaaaaatgtaaagctacttccccttcacttaaggacaggcaattctgctctactcaatctaccacagacaactgggctgtgtactatttatagattccactggctctgaaactcttcggaaagaaaaaaaaggccatattccagtgaaacagagccattaattttaaggcttaaaaaaataatgtttcaatatatattctcctcttaatttagacatcacttgtgccaattcagactgcttttcctcctgttattatccaagtaataatttacgaaaaggcactttagcatagatgaatctagaatattctaaactttcactgggctccaaggtaaaatggctgttactatggtgaaagcgtaggttttattgggaaatagaagattgtctctacttttatacacacaggtacttccaaaaagccataaagacttctaaactttttatttaaataatcctttatgaattttaacatctactgttttcacaatagtggaatttagaaaataaatgctttatatctcatatctgggaagagttaagaatttgagaagtcaaactgatccaatagtttcctggtcacatgagagaaaagcagtctatattttctaatcttacaattaaaaaattctgcaaactaaggtaatcagcttcttcactattttcaaacctcttgcagacagccactaaaccaggtagttaatcaaaagcatcttaaataggccagactcggcggctcacgtctgtaatcccagcactttgggaggctgaggtaggtggaccacttgaggtcagaagttcaagaccagcctgggcaacatggtgaaaccccacctctactaaaaatacaaaatattagctgggcgtggtctgtagtcccagctactcaggacgctgaggcaggagaatggcttgaacccaggagggggaggttgcagtcagcagagatcacaccacttcactccatcctgggtgacagtgagagactctgtctccaaaataagtaaataaatatatcctaactatattctgagagttgttattaagttcactcagtataatgttgcgaggagggaaaaaggttccatagcctagaaaccacctgatttagggaccagacttctgcgggttaaagtcatagcagggctgctgaaagggccaatacaatgacccctggtgaggctgcgcctgttgctccagccactccattgccatggtcaacatcctgacctgggctctcatcttcttcaggaccagcaaattaaagcctccaaaaggtccctctctcctcatcctaatctaccttaacaatgttcccaggtagactttctaaaccctcccacagctccctgctgcctatcaaatgaagtgtaaactactaggtatcaacagaaatcctgtacaactacttttatcagcccacttattcaagcaccttaagatctgaactactccttgtccctcaaacagtccagtaccttcactcttctagctttgtttatgcagtcccatctcccttattcaaggctccatccaaacccaccccatctccatttcaggggtttgtacaaactaagcattgaaaaagcaaagggcaagaacagtttcttaaaaattggagactgaaagagcaaatccctccctaaatgtgtacaaactaggtaacttttttttttttttttactttttacaaatacatttaaactataaattggaaacacaaataatcatgagtggctctaacttgtttttctatcccaccaagtatttcaaaccagaagtaattatgaaagcatattttcaagttttgacgcactccatcagccaccctcacccactgaaatctaaattcctattatatggtaaaaggaaaccatctacctttgtgaaaagttgtgtatttttatttcaacaatctatcacactaactacaaaaccctggaagacaagacaaatccaagcctctggccagcagggttatggatatgggcatgtggaatttgggtccaacttcaggaaaatggcaaaatcaaaggtaaatgcaggaaaattaaacagatcttgaagaaggcatttagaagcacatcatgattaagtcgtggatcaccagtgatcttcatactaactagaaaagtttaggcaaacagaaacgataacatctcttaaaagaatcatggctagaggcaaagacaagcttatctctcaggctggaaaggtccagcctaaacagagtgaacttggtctctacacttatttgcaactagaagctttgaataccctgagtattcaaacacagcacaccaggacagaatcagcccagtacaaaggccttccttctgaccacatcaaacctctccctaaatgccaagttacagatgaacagaagacatttgtctctaaagttttagagccaaacatacaaaacacaaacaaacaaacaaaaaacaaaaccaggcatcacaacctttaccacaccatcctttggggaacttgcagcagggacaaaagcactccaaaattggtgaaataagtcatatgagcttatagatgacagctgggtaggcagtcaaagggatcatctgcccgacacacaccattcctatagcaaatgctttatctttcccattcaaatcactaagtggtattttcaggatatgtttgtggtttcacttaattaagcaagagaatagtcaaccaagtgctaaaatcacaaggctaacaatgtcagttacaggaacaagccattagtttgttttctttaactctctttgctttgtgattcctaaaataaaggtttgtagctttaaatgtcaaaggatttattcaatctagaatccttgtcaattctccagcccacccacataccatgttagctgtctcactagctctacgaattcctcaaacccacattttcagccttggggctaacaacggcccaagaacttgcagagacaatgcactgaacagctgcacgcgtcataaggagaatgttctttggcagcaaacactaacgtttttctgtctcttggccctttatgacttctacggacaaagtacacagtctccttcatgccagtctttctgaggttttgtagtttcagagctggcaggttcaaaagctttgaggttagagaggtaagataatgagtttagggtcccaagtccttctcttcagtctaagtccattacaggtatccagtttgagcaatgggaaagtaaagatctggcgaaaaagatctgcttaagtttcatgttttgttcattcatccattcaacgaacatctccatgcagctcccacgaattcaggagagtcctgaggtacagcaatgaagaagcatcttggagtgctgatttgctgtggatggtgtgtgcagaacatatacaagtatgaacacatagaagaaaacagtacatcagcaataagtaagagtgctgtggaatacatatagagaagaataaggggggttgaaaatgtggagatgaagacgggtagtttccagcattaaacaagcaggcctcaatgaaaaggtgagctttgaaccaaggtttgaaggagatatgggctggctgctgtgataggaagaaaaatccccttcccctcaatgtctacatcctactcccagaagtgtgaatatgttatgttacatgacaagggggaattaagattgtagaattaaagctgctaatcagctcaccttgagaaagggagattatccttggttactgaggtgggcctaaggtaattacaaggttccttataagtgaaagaggaaggtgagactgtcagggtgatgaagcatgagaagaaatcgaaaggacattgctggctttaaatggggccaccagccaaggaatataagcagcctctaggagctgcaaaaggcaaggaaacaatctctcataaagactctgggaggaatgcagccctgccaacactttaatcttagcccactgagaaccactttggacttctgatgttcttcggaattttaagacaataaatcttgtattgttttaagccagtaaatttaaagtaatttgttagaggtctaacaggaagtaaagacagcccccatggagatatctagaagaaaagattctaggcagagacctgccagtgcaaagcttgtctgctgtgcagaatgacaaggagataacagggagagtaggaggagatgagtctaagaggtaatgaggccggaacacatagggccttgaaggccaccataacaaaaaaggaaactataaaaggttttcagcaaaagagtagcatgtggctactgtgaaaataaattgtgtgtgggtgtgcaggaagactcagtgagtttggaaacagaccagtcaagaagcaactgcagcaattcaggtgcaggatgacagtgactcccaccagggtgaagttggggagaagtcatcagattctggatatacccagaagaaaacacattattaaggtgctacattttaattacatcagtacactgttgaaatccattgtcaaaaaactggtttagatactaactgctcacattcctacaaaccaccaaaacatttactatgctctggacactaagaacacaagatgaataagcaaaggaagagattttatggacagttgtgccttaaaagaaaataaggatatatatataaatctatatatagatatatataggaaacccaacatacaaaaattttgactttataaatattaaatccagagttattcactttatggttggatattcactattcactttatatttgctactaaatgaatccactgccagcttcttaaagaatcaactgattcatttaggagcaaatataaaatcacaaatcagtagcttaaaacatgcaactactactaaacatagtatatcagaaaattgatttgtaatctatgtgagcccccttaaaactttcagaattcaaagtaaaatagctcaaagctctccccaaaagtttaaaaacaaagtggatgaagattagattaagtcacattttgtaaaatgggagtaaactttaaaatctgtatttttcaacagggtcatttatatacctctacaatagtaaaggttaagccatgagataactctgtcttggttataggctggaatacactaaatcattaccttctggtgatgaatcattccaaccccattctttcattccaacctaagtggacccaattaatttccatgccattatttggcaatagaatctaaaaagggatatgagtacaacaagaataaaatcaactactccctcagttttgtggcagaggttttgtttggtataggcagattaatctgaattgctaaattaagacagttaacatagtaatcaacacagaaattggattaacttcacattcttctacaaaagtcacagctatcaggaaccccctcagggtagtacaaattgtgaaaggctgattggaaatcctcaaattaatcccagtagttgagtgttttcattaggtaggttaaaaacatagctcctctgttggatacagacactaaaatactctgtcatgtacaaactccaaagcagaaagaatgactaatcttaaagggaaaataaaagacaaggaaggtttatggacaaaaataatgttttttaactcacaaatgttataaaggccacaacactcctcctggccagtgaggttaacattttatttttcactgttatttagcaggacttagagatagaaaaccaaatgctacactgtttaacctcaagcagcttacaccaaaaaaaaaaaaaaaaaaaaaaaggcatctaaaatgtcaaccaacaagatttatttccttagtaacattaggaggctacaaataaagggatgccatcccagggcacataaatatcttagaattcattgatgtattgtggagagcaaaacaaggagtctaaaaaccttgatcaatacagacagcttccttctgctctgaactgtggatcatctcaattactggtattcacctatgaaatgtgtttttcttttctgttgatgtgtaacgtcctgagattcccaagacatgtatacttgtgatttagagacacaactatgttttatttactatggaaatttgaggcatcttaaaaaaacaagattcacaccctaagatagtaactttatttcctttggtccacctctgcctcttgctcccccaaagacagctttctttaaaaaccgacatcccagctagaacaaaacacacctaggtacatctgtgactttttatggtaattaagttcctggttatttactacatttcaagaaaaaaaagtgggggagggggagaatttacattcaatgcaagtgttatttttattcagtgattccaaagtgaggaaagggttgctaagggcgagaagtatctcaaggaaatgtcttgttaatctgctacataagaatgtatataagagttaataatgtttttcaaaaaagttaatgctagacactatagaacaggtaaggcccttcttagcctcagaccttatccacttatatccacatcaggcacatacacccaatttcgaacaaccccctaacagagaaaggggtcaatatgcttagattgatgacctcaccatctcacccagcatagagcttcctcttactcctacttttgtcagacttcccgctttgcaagttgtcttagtatcattcaagtaaagcacatttgaaacgaacgcttaaggatctcaaaaagtaggtggggcaagtacccccatgttacagatgaaaaatgaagcaagtgtatgagcatatatgtatatgtataacctgtatatacattatacacacatattcccaagtgttgatgagaaacatctatcccccacaggctgaagaggagaagggagcacatacgcaattacaggctacattttaacaggaaattattcttaagactcaaatcacaaaagcattagcctttgaattatttccactctaggaaggaaaagagcaggtaaaggggtctgttctctttaaaagctttaattacatatacatattttgtctgataatgtcaaagcactttacaaactctaaggtgccaagtgaacagagggtattatcattattgctggacaaaacaagatgtctcttaaaatgttagcatagaaaatttgcttatctgggcctggcgcagtggctcacacttctaatccctgcactttgggaggccgaggcgggcagatcacgaggtcaggatatcgagaccaccctggctaacacggtgaaaccccatctctattaaaaatacaaaaaattagccggacttggtggcgggcgcctgtagtcccagctacacgggaggctgaggcaggacaatggcatgaacccaggaggcagagcttgcagtgagtctagatcgcaccactgcaccccaagcctgggcaaaagtgcgagagactccatctcaaaaaaaaaaaaaaaaaaaaaaaaagaaagaaagaaagaaagaaaatttgcttatctgtcttttggattaagcctgtcagtttttcttccccccacatctaaatggacagcaaggctgcagagtcgtgttgggagccttttaacatggaaaggaaagactgtggacagaaagtacagtatgcagacttttcctaatcatgactgttaattcctgtcctggactgctgaagcagatgctatgttaaactacatttagcacagtcacaaacggtgactaaggaagttaaaaatttttacttgcaatgctgcaatttttaaccccagacctccaaagactatgtttaaatatacagagtactaacagcccaagtacttcacattagaattacagccttgcctattttaatttaccttatttttaaaagtgtgtgacccccacccccctccccaactccccataaaaatacacatctcccatcctctttgagcctgcttatgctcaggctcttggaattttaataagattagaaattgctacctccttattctggctaagaactccaaagatgatccaggcatcttgtacttatattcagatttacaatacagagaaaacaagagtgtagaaatctaatccacgattataccctagaatctagattaataatgtgtacattatgagatcacatgggatcaagtttccacaattaatggatcaggcaaatgatccatgtatctacattcatacaaaatcatacactctcctatcatctttctcctatcatgatcttcaaaaatgacctgaatttaaactgtggctttaaaatcacatttaattacaagaaaaatagaaaaggaactttccgtgggatttgagtatcttttgctacagtaaagaagttcagatgatctccctgccttctggagaatccaacgaatcctacaactaaaagtaaaaataaatggcaagggaaagaaactagcaattattgattcctctttccatgccagtctcaagctagatatttacaaacaaaatcttatttaatcctcttgtggagcgggcaaggtgactcacgcttgtaattccaacactttggaaggctggaggacaccactgcactccagcttgggtggcagagcaagaccatgtctccaaaacaaatcttatgcactataagctatattacattctcttcaatttacaaatgagaatttcaaaacttcaagagttcacacaagtattaagtgagaaactgggatttgaaatcagtgctgagaccccatctagagcttcctagctgatctctctatttccaggcttgcccctttctccaatccttcctccattccacggctgtggggatctaactaaaataatgggcagcactccactactatctcttttaaagctctgctcactccacgttgcctatgaagtaacatctcagctccctagtgaggcagctgacttgaccgagctcctacctcttcatccacatgcccagcacccccgcatcatatacacaagctctaacaagctcccagtagttcttcccactcccagtgttttccagtgtcacccaacctgttttctccacctgcaacagcctacctttcttctcctgcctcatggaaacatcctcagcaccggaagagagcagacaaacctcgaggaagccttctgtgaaccactcagttggaccagataactctgtgtgctcctatatgcctgactcacctttatctccccagtaaaaaatatcaagacagatccataaagagaatgaatgccatgaattgtgattcaaggtggcaagtaaaaaacaacccccttacttatccatgtggttttatgttccctgccaagtgggaaaaatttccattgcaaccctgtatagctggaggagcagccaaagtcatctcaggttgtttataaagaggaaggtagactgtcaaggggaaaaaggggaaagtaggctgtcaagtcctaccactaacacacacatctctttccgcatatagctactaattccatattgtaagctcaaacttcaagtggaatcagcattttttaattcctagctacaagcctttgttaaaacaatataaacctcagggaggaaccagggacaggtgtgttccattgtcaccatctcacagttcaaaataagccaatctcatcaccaatgtgtaaaatcaagaggaaacctgaagtttatactctctccccaacacagccaaggtctggtgtgtagaataccaaaaagaggagtaaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctacctgacctatgctaaatagtttgctatcaaaaaaaaaaaaaaaaaaaaaaagatggcaaaatcactgctgctatggaaactaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtacccatttcctgttacaacttcatcctatgtaaagtacaagtttctttaaaagaactctcagtagagtagatttaacatgtaaattgcttagcagtaaatagtctttaactgttgataaaactttcaggaagtacctactaagtaccaggcaatatagtctacagcagttaggactgcaatctctttcagatcgagctaaaaagaaattctcgctatcatccactactttaatctgagatgggtatgaacaaaaagatccttaaaccactcttctaaagggaaccatgaccctgaacccaaatttttcaattcttctgtgaagagtgtagatctactcaaatgccactctatcgctctatcttagactattttaaagagttccttgacgattctgagtgccagtctctagttgagaatcactataagggaaatagatggtttagaaacgtgccctttctatacccttctgccccacccaagcatgctttttacatccatcctttgtcaggctaaaacccaggattcacaacaaagatctggagactgcaggccttggaattgagttgagtcatcaggacactattctttattctccatttctaaagagcaaaagtgggaaacggggggtatcatgaggtagaagcaagaacggtaaattaaaactgaagaaaacttccactgcactggaacagtaattagaccaaatttgcctgccatcaattaaggaagaacaactgctctgcatcgctggctaccaagacagcagttagttctcttaagtaacttcttgctctaactggaaaatgacccatacttttacttgccaagaataaagacagctggcctcctacattacaaataaccaaaatggaaacaagtgaatcttttttatccaccaaggttgactacacattaactaagacctattctaataaacatggccaacataaacagcagcagccaggtggcctactctgaacattcttcctgatacaaagtacatcatatacctaagggcatggtgaacaaaaccccccagagtggctatgaccagcaggaagaaaacattgaggggatgggagtcaaaagtctacttaaagtattaagcattcaaataaatggcagaatccgagggccagcttgcaaaaacaaaaaataaaaagccaacaatggactctgcttaaataaatcacgtgcgaggttgaaaagaaggacaaaggaaaagtggcaagggatagacaaaaacaagcagattctgtaactctcctcaacctccaggccaaagttcggactggcagctagcgggtagatttagcctgaaaacatgttacgtggtttctccaacgtccttaaaaacaaaacaaaacacaaacaaaaacagtagtgttcaacatttaaaatttcaccaatgtaacaatttcacattcataaaactatatttctgatttcgcttaataaataaagtttggcaagagtccatattcccagagctactagccagcaggttgccctataaatggggtgccttctttccagctctcccaatacagccttaatgttccggcccctgcaagggctggattttaagtaaaagagtatcatagcctaaatgtcaaatgtgctaaagagtatatgcttttctaccatgatggagaggttcagaatgtcagagtactgggggagggagggggttttccaaggtcatctaaactgaggatctttaattgtagacctaatcatctgtgaaaatattctaatgaatatgcataacaaaaaatgaggcaaaaaagcatcaagtctgtgtcactaaacatcctaatatgactgccacagacattcaaagcactctaaataactcattttggcctgtttatactactatggatttggattagaaagtcatcctgtccacaaagaattaggtatatcctgtcccttctgggggctgagtttgagacagttaattcaaacctaatcaaatattttgctatgagaaagaagaggaggggccaatgaagtgctttatccccaggatgaggcagtgagtagggcagcacacaaaaaagataaaaatcacctggcactacaccagaagcccttgaattaacattaaatttccaggttaacgctctaaaaactgtctcatgacaaaccacaaattgtattttggaggtaaaacaggaggtaagtggggaaggaactgaagggtaaataagaggtcttacttcacactttttctgctgcttttggtttaccccagtagaatcccatgaaaacctgcttcacactggcaaagtgggcagacagaggaacaaaggcaattccagggcctgcagaaagtcttcaaaggcaagggaagaaagcaacgccctgcctaaacactggctatttatagcacagcaatggaagatctgggaggtggctgagggaatatgaaagctagagagtgggtgggcgggcttccttctggcttccttagactcagaaactaatgcattcttccctgcctccaaagctgctattttgtttcctgtgtaaggtttcaaaatactgcaacactgtccctaggtgcatttgacaatatcagagcaattacagtttggttaaaatctgaaggtaatcaactcaccattctttgctattctctagaaaaagaggcctgaacaaagaggaggagacaccaccatccaattcataaggatggtctcccaaaatcccctgaactttcacagcgcggaaagtttctgtgatttcaagcagagaccaggagaaactatacttttcacctcttctcattaactaaaagccacagctaaaaataaaaagctggagcaattccaaaactgtgggttttatagggcacattaaattattccttatcaactgcaaacctttaaggttgcagagtattatgttaatgctattggctttttcttttttttccccagaatcggtgatagtgttccttaaaaaaaaaaaaaaaaaaaaaaaaaaaaaaaaaaaaaaaaaaaaaaaaaaaaaaacttcatgaacttccaagtccaatctctattgcaaagtaaagtatgggttcctaaatctgcagagaatatcatctattctacaaaacctcacacataacttaggttgattctcttttccaggactgtattataaaacattttgaactgagaacagatcaacagttggtattaatagtaaattataataatcattttacacttgtttcctaatctcatgcatgagattcaaaaataagaaagcagtctaacaacagagaattttctaaacagaatgtgaagctctcacatttattcaaatataaacactaaaaagtgtttagggttccccctggacattcaattgttattaactcttaagataaatttccaacttaataaacttggaaaatggctttttaagcatattttcaatttgttgaaagtttataatattgaatcctatgagtctttttataattattttcttagaaaatttgtggtcaatttcctgtgaccttcgtaaaacttaaacacacctcttagctcacatccataactatgttggcttataccaacattcttcttatattcttcattaatggtcaaggttaaagaaataagagtatttggtctaaactcaaatcaaatgatcatgtgtaacacacagcagcacccaaaacataagcactattttccataactaaaacatcagaacctaaggcatccatttataccaaaatgaagattttagttcagctcttcaggagagttaagacatggccaggtaaattaaggccaaaaaagggcaagtcacaacactatgtagcattcaggaaatttggagcaaatttaagctttcacataaaacagtcagggttaggagtggcctcagagaagcaattatctcattcccaagtcccaggctaacaaactaacagggatatggaaaaaaagactagaacgaaggtaaaagcctacataaagtccaaagacaatcactgctggtcctaaatctatttcttaatgattctgtgaccctcaacaagtttgttatgttcataacttccctcatctattaagaacagatttttctcactctgctagcgaacagggttattaaaagaaataagttataacaaattacagataaaagaatggcttataaaaaatttcaggcactatacaaagtagggtattgttctcaaggcactaaccttcttgagaattgttttctgctttcatgctctcctaaaaacacatctttaatttatggtaaggtcaaactgccattatcactgcaacctgagaaattcaaattaatggtcaaagatacacataaacacacacactccaggctttgctttcttctttccctcaaaaggtcatgttttcaccaaacagatcaggaattctacaatatactacgttccaagtaccaaatatttaagccaccaaaacatacagcagaatagcatatttaagaaaagtttcttttttttctttccttttttttttttttttgaagataggttctaattctgtcaccaaccaggctggagtacagtggtgtgatcacagctcactgcagcctcctgggctcaagggatcctcctacctcagcctcttgagtagctgggaccacaggtacacaccaccacaccccgctaattttttaaatctttttttgtttgttttttgagatggagtcttgctctgcaacccaggctggagtgcagtggcgggattctctgctcaccgcaaactctgcctcccgggttcacaccattctcctgcctcagcctcctgagtagccggcaaccgccaccacgcccggctaattttttgtatttttagtagagacggggtttcagcgtgttagtcaggatggtctcgatctcctgacctcgtgagccgcccgcctcggcctcccaaagtgctgggattacaggcgtgagccaccgcgcctggctaattttttaaaatcttttgtggagacgaggttttgccatgttgctcaggctggtctcaaactcctaggttcaaaggatcctcccacctcagcctctcaaagtgctagaattacaggcgtgagccaccatgcccgaccaagaagtttctttaacataaaaatgtccaagcagataaccaagtcaaaacacttttattactgaacagcagacggtgatgttttagttggcaatttaagaatcacacgctatagctattcctgaaaaattcaaaatcaaagtacatcgtaagcatttgctcagaggctagcatagtgcttaacgcagagtcttagcattctcaaaaacatgcaagaccagcctggccaacatggtgaaaccccagctctactaaaaatacaaaaattaaaaatacaaaaaattaaaaatacaaaaaaaaaaattacaggcgtgtggtagtgcacacctgtaatcccagctactcaggaggctgaggcaggagaatcacttgaatctgggaggcagaggttgcaatgagccaagatcctgccaccacactccagactgggtgacagagcaagactgtctccaaaaaacaaacaaacaaacgaaaagaaaccaaaccaaaacaaaaaaccatgcaagagcttaagccattttaaagagctgcaaccatgaactaagatttagcctgaagacaattagcgtacgttccatcccataccaagaaaaccactttatatgctcaaatacttcttggtatattctgccaatgaggcgattctacctgaatttattaataaactatttaccagcctgcttgaccaccaaggtttggtaaacagacttgggcccgatgtggaagcatagctaaggatggagaccccggggcacaagaagtgagctgaagtgaaaccaggaaggaagacaaatttctttgatagcctcttctctttccaatcccagcttcccatctcagttgctcattgtgccttcatcccctctcccatttgagagctcagctgagtctgcagatatcccaagatactaactggtaactatttggctagagtgagagcccacttcattttctatgcatccaacaaactcttatctcaaaagggcaataagcatacctggaatttactccaatacctgtgaaaggtagccaaactctactctccggaggcgtgaagtcatcatacttccagataagacattaataagcagaattatccttacctcatttgttacactttagtcctccaaattaaaaacagccaaagagaaactagcttgtaaacaaaagtaaatattcaaggtgccaagactggaagacagcaagatctcactcagctcacagtctgaagccacttaaatggagtaactccaaggaaaaccgaaagttaaactgaagaaaaacatgtaacttcagagagcatgaaaaactggtacaattctgcacaactacaaagtggccatgcactaacctgaaaacaacgaggttcattattgaataaaggcatcaggaattcttggagatggagctttcaaataaggctttagtcaccactaaaaggacacagaagaaaacagatatgcctcaaatatcaacacatttgaaggacagacatctgcattcattctaacatgcaaatcctatgtgcagggcactgtgctggataaccaagatgactcagataaggagttcccacttactgtctaagcaaagaagggaacacatgcagaaccacaacacaggacgcaatctggtaagtgtgagaaggagagattgtatctggatgacagatgaaaaaaaaaaatcaggctcagaacagagaaaagccatgtgcactaggctctctgttgtcataggttcaaataaagggcaaagtacacatagttgcaatcatttttaaaatgctgggcacaggccgggcgcggtggctcacacctgtaatcccagcactttgggaggctgaggcgcgtggatcacgaggtcaggagatcgagaccatcctggctaacacggtgaaaccccgtctctactaaaaaaaatacaaaaaaattagccgggcatggtggcgggcgcctgtaatcccagctactgaggaggctgagacaggagaatggcgtgaacctgggaggcagagcttgctgtgagccgagattgcgccacgacactccagcctggggccacagagcaagactccgtctcaaaaaacaaaaacaaaaatgctgggcacagagactatagcataaacaagacaggtactaagggaacttagtgggagagacatattaaacaagccaaagaataaagctaatgtttagaattgcagttcatgccatgaaggaaaaaaggatgctgtgggaataaaactgggacagtgatcagaagaaaagccttctgcagattaagtgacatttaagctgagatctaaagataaacatgactacatatatgtaatacttggtctttggaaggtaaaggatggtgccacacacatactaggtagtgttgggggcagtgggactggtgaataagacataatttgtaccctgaggaatgtcatcctagggatgcaattacatccaatatgtggaacccagcaggcagagttttacaattatggataaaacttaagctacagagatcttgaaacccatctatcctcaaccattcctttttatcaaatgaaggaaatgaaacccagaggctggctcagtgtttctgaactaggtaggtgcagaggtggggcacaacctgtaactcccattacatcacactgccaattaactttttaatcagaatttatgtggaatgtcagaattcagtaaattgatcatgtacaagaaacacttaatatccgtagggaaaaataagtagacttgggcctaaatgccaagtacttcactagacattgtgggaaaaatcttatttggttccaggcaaaataagaaatgtaatgagttttttgtaaagtgaaatatattcaatttctcttgtgaagttacgtgcatcctactttggggcatctaagcaaaccaggaaatgacagtgataatagataatgtgtcagatggtcttaaatgcctttccttggcaaaacagagttgacaaacctattattcccctcccacaatgtacagttttacttcttattgtacttccctgagaagtacatatatcaaggaacaactgtcacaatgagggttgaggcagtagagggagccactcccagagttcacagcagcactgttcatcaaagcacaagaaatgaaaacaaagtgtttatcaaggaagatgaacaagaaagatatgaagataaagtcatacaagttcacacaattcaatgttcttcagcagccaagtaagagcccacacatagaccaaagcatattataaaatgagaattttgatgaatttaacttagtgtcctggaggacaaaaaaggacttaggatcttttagttatcacagctgcacctacaagtcaaatataggcaaaatgaaacatttttaatcagatatctcccaaattttgcattactttaaggatagtgtgaaaacaaaaataacaagggaggaaacaatccccttcaaattgaagccactatagctcaatcctcactgtctcacgtctgttaacccaaaactcccagtatgagtacgaatcagtcacgacatagaaatctagacctattctgtcaatgagcagctgctccaggtctgcatcaatctgtaaacaggtatttccaaagcatatgaccagctccagtctgagcagaataacagatcaaaactggagaggacacacaatgggaaaagtagttgatcggtttgatagaggaagagacactgggtcccactcaaaaataaagtatctcaactttttcactgaatttacattcccaaagaatagattgtaaaataagtaagaatcccagacttttcggtacttgaaggtcactatgaggtcacctggcatagtgatctactgcaagaacagcctgactggtcttcactgatgctacattctattttgtactctgtctcaagctagctgaacttgagagacttctaagtctatccaaggacatttgaaacatttgtgataaatgcagagtatttatctctgttaacaatgaagaaaagtcaccttccagaagaattgctgtgaaagcccacatcgtgtgcactattttttaaaaagtaacatagaaaagctgtttaacataccaggaaagtcaaggagaactttaaaaaaattataaccataatacctaatttcatcaaaatgatgtaagcaacaaagatctaatttatattgagataaactatataggctcagactattcaggcaaggaaccagtaaatgcttatttcatactgaaatttacaggacatgaatgacttagcaatatatattgaccctgagctactgaaatgacaacaacccaaaggtgattactgacatatcagaagaataacaatgaaacttgagggcgagagtctctttcacactttaaaaaaaaaatgcagctcaataaaaatgtacctattaaaaatagaaagacagttatccctttcaactggtgttgatctgccctttattactggagatagactgtatcactcagaaagttaccctgaagctataagaagcttggaggaaaatattaaacttcaaggtacagataggaccaggagcctgttaagacagaaaacgaagacattaatgttcaaaaagtatataagcaggaaacctgcagtagtctcagtaacagattttagtggcaaaaaaaaaaaaaaaaaaaaaagagagagagagaaaggaaagccttttaaaaatctaagccactggaattttaaagtgacacccacatgacccagtttacttttctattcaaagaagttctgatgctgtttctctatttctctttggaagtttttcatgtccaatatattgcaaaagataaaaggtacacttttatttaagcacacaatggaataaaacatcactgaggaacttggacctgtaaataaattttaatgggaaagacaagaattcaaacatgaggaaagggcaacagatatatatacggcaaatgtgagaaagaatatgagcatttggaaaaggaagacaacattgttggacagggtaggatgacagctattaatttaatttaggatatgctaggccatgctctaagccgttttaaagggcattacccccctgtgatcctaataacttaataaaatgggtcatttcatccccattttttttttttttgagacggagtttcgctcttgtctcccaggctggagtgcaatggcatgatcttagctcactgcaaactgcctcagcctccagagtagctaggattacaggcacccgccaccatgcccagctaatttttctatttttaatagagatgggtttccaccatgttggccaggctggtctcgaactcctaacctcaggtgatccaaccgcctcagcctcctaaagtgctgggattacaggcatgagccaccacgcctggcctcatccctatttttcaaatgaggaaataggcttaaaaaaacaaaaaaaaaagattaacttttccagaactcacaaaacctgccaatgtgggtctaacaaactccagagcccatgctctttgcaccacacatcaatgaagcagctaaaataaccaatatcttgcttcaccccagaccaattaaataagaatctctcctaagggcccagatactggcatttttatcagcacccgatttgattctaatctgcaagcaaggatgagaaccactgtaaaagacttttgtaagacaagtggactatcagctaggtagtgccaaacaaacaagagtcaaataatcagagactggggaattcatccagcttttagagggcaaacagaagttcaaaaacagtggaggtgctgaggcagagctgatccagactaacttcagggaaagtctgaacacaggctttagtccaagcagtgattaaaaaggcgcaaaaaaccaggttggaatcattttgctgagagaatgaactacaggttagaaaatttttacttttaagactgtaggtaagaagggagcacaaaatgacttttacagctaatgtaaccaatgggtatgaattttaggaaaataaggaaaaaataacagttgactaacctaaagccaatggaccaggatataaaatataacaagtgagtgacaataaacagagcttgctgagcaatcggatatagcctagtagttacaactgttaactctacggtgatcccttctagcatttgccatcctaagtcttgatttcctcatttaggaaatggagaaaataatcctatcatctcattcagttattggaataaatatatgagatatggcagtcccctttttaccaggcactcaaaagccccaatagatgcctgaaacttcagatagaactgacccctaccatgttttttcctacacatacctatgataaaatttaatttctaaactgggcccagtaagacattaacaataactaagaactgctgtaacagtacactgtaataaaagttatgtatatgtgatctctcagcgtatttagttttctttaagtcgagaactttcacctttttacttaaagggaacatggagcactttaacatcctctctttggcatgtcagaactgccagcatcactactcttgtgctttggggccgctgaaagtaaaagaagggctacttgaacacgagcagtgcaatacctcgaaagtcaatcttataactgagatggctatactaagggactaacagcatggatacactagacaaagggaggattcacatcctgactggtcagcatgagggtacatcacactattcagaagtacacgcagtgtaaaacttgtgaattgtttatgcctggaattttccatttaatatttgtgaaccacagttgactgcaggtaacggaaatcatggaaagcgaaactgtgggtaaggaggaactactgccatccaagcaaaagaaaagagaccaacggcttctgtattcttatagagggcagtgtaagaatatagtcccccaattttttccttcttaccattacaactttagatggccttgttaaagactcagtaaatggggaatagaagtttggcctgcttattcagttcctattagtccctatatagagggactgcttattcagtccctatacagagggtcagtgaccctctatatcagtctaggccagtgcccagacactagacgcagccacaagaaatgcaagttttcctaaatggtaaggtggaatgtatgtcccctaaccctactgaagtgaccgtcatttcacaaatagtgaatttatatattaagtgatttattaaatttatgctacatacaaaattacgtattaaaatgcatatgtgtcctcaactgaattcttgaggcatagtattgaggaaacagttcaaaatagtaatacaattcggtaaaacttttaattatttctcaaaagaatccacacaacttaaaatctgacacctgctgaatgataaagcttggtcatctgcacaacttcctattcaactttcattttcacaaaccttattttgtcttaagatgatttccacgcactcagcagggtaatcttttagctaaatgatccgaaacccacaatctgaatggcaagaaattgcttcctaaataatgtatcgtattatacaagctatcacatatctcccttccccagaaaagtaaataaacattcttaaagacagcccagaggaaaacagtatggttgcaaaacagttagcttcttatatctttcaagactttactaaatgtcacttataaatgagaaaacatatttgaagtttttaagtgttctatgctttttaaaccctttcctgaatgtatacaggtaggacactcagaggtaaggtaaggggtaaccatgttcctaaattacattaatttctaatgcctgaaaccaaagttttcaaagggctataaatgcttgaataatccattaagatacacaaaatgacaggttgatggtaaaaaaggggaaaaaaaaaaaacaacctttcaacaaatgacaaattttctcctaaatcattctttggttagaggaccaatgtaaaagaggcaggtccgagtgctgttttgtactggaaacaaaacagatgtaacaggtgtaatgaataccagagagagatgagacagaaaatcttgaaattaaacttctgtggtagaaaaaaagagagggaatacaaaaatatatggaaatgcctggttggatgaaaggagagtagatattctaaccaaaccatttaaatccacattattagacaccccaatacccgctttcccagtctgtgactgcacaggtaaagccaaaatatattttctgctttggaatagattttctacttaggattagttacaggcatatcggctgctctgggaattcactttcaaatataatgaggccacactaaaaacttgaaggaagtgaaatagtatccttcatctcatctgtcaccataaagctcaacgtaaagaaagctaaaaggctcactgcagtccctcaagaaaaagttaaaggtttgactctctgctgattaccttgaatagacagccaaattaggctggagcaaataactataaactgactatctaatgtaactaggcattagccattcatcccagagctttaattttatgttttatatattacggttcccctggtgattttccgcatacctcattaagttctgacttgaggatgtctgctctggacgagcacacagagcaacacaacacaaaacatcctaaacctcacatctcttagtatttccaacacaaacatcgcaggtctcctgatgaacacttaacctctacatgttctctaagtacagagtgcctagagtctcagagctgcacagacaccagcagacattctgtgaaaacactgccaagaccctcttgacatctgtggcaaaaacatcctgtcttctaaatatatgttctgtttaagtggcttttaaagcataagcatggtgcctttaaaagcagtttgtaacaagaggtcaaactataaaactgaagaggttagagaagaaatcaattgtatatcaattgtcaaaactcaactttaaaaggcagaggtggtcacaaactactgtacagacagggtaaatggaaaagaaatctccaggttgaaaacggcaaatgctaatcgcaggggtgggagcaaggagtcttgaccaatcgtaaagatgagaaagcatttcccttctggaatgaaaaactaaaactgtagatcagaaattcaggggaaaagaatcatttctgttcatgcctcgagaaattaaatacccttacccctgttagagaactgaagtgtatctcccaaaattaacatgttgaaaccataatctccaacgtgactatatttgaaaacagggttgtgtagttcagtagtttcagtagaaacggtacttcaagtaactacacaaccactctgtttttcactctatttccttaattatttcaggaaataaggctaaatgaggtcataagtgtaaataattaagaataaatgaggtcacaagtatggggccctaatccaataggattggtgtccatataagaaaaggaagagacaccaatgatttctccttctttacatacccagagtaaaagctaagtgaggacacagtgagaaggtggccttctgcaagcctgaaacagtggtcttgccagaaaccaacactaccaaaaccttgatcttggtcttccagcctccagaaccatgagaaaataaatttctattgtttttgctacccaggctatggtattctgttatggcagcctaagcaaactaatacaacccccacaccaattcttaatctctcagttgtcttttcctctcattgctgccacccaatcttttcctggaatctgaaccttaggtatgcaaatagtccccaacttacatggtttgacttaacagtttctaaactttgtaatggtgcaagatcgatacacattcagtagaaacagcacttcaagtaactacaccatcattctatttttcactgtcagtattcagtaaattacatgaaacattcaacacttttattataaaacaggctttgtgttagatggttttgcccaattataggctaatgcaagtgttctaagcagatttaaggcaggctaggcgaaagctatgatgttaagcaggttaagtatgttaaatgtattttctacttatgacatcttcaacttaacttaaagatgggtttatcaggacataagccccatcataagtcagagcaccttcttgtagccactgaaccatgccccctcgcttttgaatcaacactgtcatctatccataactgctaatttaccttcactaaaatgagtgtctaccaatatctacccctcatcctccaattcccatgagaccagggcaagcctttatcatcatatacactgcttcaaatctgtctcctcctccaacatgctcatctttatataatggctagcttcaacttcccaaaaacatctcatgctatcacttgctcaaataccatcaattgtatacatacagaccttcatttaagggcctttttaactttctaatccatccctaatgttttctcccaacttctcaagccaaaaccctgcataaggtcaaaatgacccataaccatcctctgaatctgttgcattattttatttacttccttttttcatatttttcttttattttttagacacaagttcttactctgtcgcccaggatggagtacagcggtgtggtcacagctcacggtggcctccaactcctagaatcatgctatcctcccccgtcggccttccaagtatctgggactacaggcatgcatcaccacacccagttattttttattttttactttttgtagacacagggtcctcactatgttgttgagactggtcttgaactcctggcctcaagcaatccctccccgcaaggcctcccaaagtgctgggattacaggagtgaggcaccactgcctggcctgtttccttgcttttattcctattgttgtgacaatttggaatgtcctctctgcttatttcctttctaaatggcagctggaagaaagaagttctgaagaacattacacaatcacaaggggcttgttatggcaaaaccttctaccctcaactgctgctctgccacatactgattttattcaaataggcttttacctccaccaaatcatgccaggtacttacacaatatctgaaagatggtaccaatttcagctccacataaatagaaaatgggaagatctgacacaaatgaaattcagagttttcagaggctctcatctccccctaagtattatcatcctaagtaaggtctagagaccatgagacacacatatagatttgatctgagctcaatcagttcttctctcaaaccctcaactttttttctaaagctatcacctaaatcccagcaacaaaactaatagagtctctcagattttcccaattttcaacgatcccctcccctatcattcctccaaagaacatcataacaagcctcttcaacactctctttatgagagcctgagcttcgtaacctatactggatccttattgattttcatcatgtgagtgacaaaacacagtaatatactaagatttccaacaacctgaatacctggctcttgatttttacatgcccccaaaatagcctctgtcccactcagtggactttccacctccaaacttttataactattttctccactcatgatcttctccctactggttccaatttacacgcatgctcttcattataagctttgctgatcttctctaataaattttgcttacccctttaaaaacagtcctccaagagctctttcctggtaacttagcatgcactatatcatacagccatttgtaaggccccatcaatgactccacctgtatgtggtcatctttatatagaaacccaaccagaatggagacataaaattctagaagagctttagttctttcatcattgtgatctaaatcaaagggcactgcagtcagcagcacccagagatactccaatgtcactgactagcataccaacagcattcaagctgcttcatgagcttatctttccccttctaacttcagggttggtagggcaaagaaatgacaccaatgacatctacaatcagggcctggaatcaaaagcaaactgatagtgtaacattcagggacttcagtgacactttcctagaacactgagtgcccaaaagggctgggccatcagcttcccctaaagaggggaaaagaaccacccactttctacaacagattgactgttaaacacacgtacagcaggcctcttgcaggagaaaaggcaagctgtcctgccagagttcctaaaagcttctgaggacaacaatttttcttagggagtgaaaatatataccctaatccatactggatagacagcccccatttttcaaattcaaggctgaataagatacattcagttttaaacattcctagaatttgagaattccaaagtatcaaccatttttacatcaaataactacattagtcaaaccagactaattattaaaattacacaaagcttgtacaaatcaatccttaatgtttaggaaaatcatgaaaaaatttgtgtggggaaaccagtctaatcttttcagatccagtacaccaaccacttggcaatgctccctacaatctgggaagatttcctgaccaatggaatacagataaaatatggcagagtatgcattaatccttccatcttctcttgttttaataataagtagagagccaggaccatacaaattaggtatatacagctcctagaaaaataaaatttaactaaagctaaagaagatgaacacttctttaaccaaatttcccaccttattttatcttatgcacacctacaaaacatctgtatacatgccttataatagcttttgatcaactgctatcaaaacaaactaaaggagtaaaataatattactgctcttcagacattaaaaaacacatttctaagcaatattttcaaagtcaacaactttgaaaaattaagtccttatctttatagaccacaggctcattataattaagtgggtagtttgtttatattttatataagattccctaagaacctaagatcctgccagtgtctatttaagaaatggagaaaatgttgggcgtggtggctcatgcctgtaatcccagcactttgggaggctgaggtgggtgggtcacctgaggtcaggagttcgagaacagcgtggccaacatggtaaaatcccatctctactaaaaatacaaaattagcttcgtgtggtggtacatggctgtagtcccagctactcgcgaggctgtgacaggagaatcgcttgaacctgggaggcggaggctgcagtgagccgagatcacgccactgctgtccagcctgagcgagacagagcaagactccatctcaaaaaaataaaaataaaaaataaatggggaaaacaacattgtaagtactggaaaatactacgtccatagtcattgatatataaaatgtctcaaaaaataggactgtcataaaatacagaacctcttacagagaagaaattttaagttgccactattaaaatggaatttaaaatctcaagattccacatatttaagaacgaatattcctttgttcatcacaaagctgagacaaaaacaagacatttaatggcaatgtgtctcctccctgaaagttgattttattgctatttagcatttccaggaaataatttctaagagctaaacaatcatttttaatattgactcctcttcacagcccgctctgcagcaccaccaccttcttacaaaccgggggaaaaatgcataagtggatgtttaaattactttcttgatcaatattgtttcccaccagattttggaatattatgaaaacgaagtgtacccattttggtccttggaccttcaattgtttcttaatttttatgagaaacaaaaatttgaacagtaatatacttctgcaatccaaagaagaattaaaccaaaagacaaatgatgaactttctaggtcctactataaaacactagagttagaagggtgatcattgttaacatacaactctggttcaagccctggttatggggctttcactgggttattacagttcttgttatttacaaatgtggaagcttattacatataaaagctcttacttctaataacctttgggtaacttgcaatctccatttaaaaagcctcttcctcacaattactgtccatttgaagagcgatttgacccatactctgtcctttgagacatcacataaaaggactctcacctactcaaaaatcaatcttttcagtcagatgaaatcttaatgaaagctgagatcatctcgaggaaagcaaaatactgccaaaaggcaaaaacagcttcacactctaacggtaaacccacaaaattgccagattaaaattctgctgcttagtcattatgatccaaagatgcatgacttgcctcactagggcaatggctgtctataagtaagatatctagagtttacaccatccttacggagagccttgacactattattgccaaatctatacgtagagttagttccctgcacaagaagatatttaattatagctctataattttttttcaaaacagagtaatatcccaaatatgtaaaagatatcctgagaacaattgcccttgcccttcgtcctttgtataggttattctactgattcaatatcagtcatggaatatactagagaaaatagattctgacttgcttatctcttcattttaaccccattttcctcattccaaatagtaaggatgcatttgagagatagctaactataaagaatgaggacagggacaatggactgcaaagctggttgatgcagagtccaactcacaagcatgacatggtagccaatttagctaaatggacacaggttgaattaacctgacctttatgcttcaatgtcctaatttgtacaatagctaccatctgcccagctgagtcctgagcagctaacaacaggatttgaagagtttaagattcgagacaaaaatgaaccaaaatccagaatgaatcctactaattctacttaagcccaaaagtgaacctctatcctctgtttaaaagaaaaacacaggcgttttcaaaaaaatacaaccagtaaaggcactacaaaaacagcacggctttctaaatatcattaaactgatcttaaattgtaatgcatgctaagtccctagcacatcacaggaacagtgtaaatataaacacaaactaaatgaagaaatgtgtaagtcatcttcatgttatctggtaaatctcatgtatgatacacttcaataaaatcccaaaggccagctattgggaatttaaaacagaaagggtgcttggtagcaggaggggcatgggtggtagataatgacagaaataattaaaggtagggactgagaggagattttttaaaggacaccaggtgtacgatttaggtttgccataatgatatacttgagtgaataaaaagtatgggatgcgggcgtggtggcttacgcctgtaatcccagtactttgggaggctgaggcaggtggatcatctgaggtctggagtttgagaccaatctgaccaacatggagaaaaccccgcctctgctaaaaatacaaaattaggtgggcgtggtggcgcatgcctgtaatccgagctactcgggtggctgaggcaggagaatctcttgaacctgggaagcggaggttgcggtaagctgaaatcacgccattgcactccagcttgcgcaacaagagtgaaactctgtctcaaaagaaaaaaaaagaaaagaaaagaaaaaaaaagtatgggataagaattcatgggtcatgatcaagagaaaaagttatttggctagttcatgaagtaaacattgcatccggcaaagaagggagaactctgaatgcctgaaagtgtttgaaatctgttctgtaagcaatagggagccactgaaaccttcaggcaggatgacagagccaaagctgtcctttaactgtctcttacaagattctaactcaaatgtgcctaaattctgcaaggttatttatctgaggagacagttcataatattagtgcaaaaaggtcgcaacagcaaaacaggaccctttatttgattaaataatttagttctaacacctgggcagagagaattccagtatagatgttactgtgcactctgaagccagactgcgtgagttctaattccagctctgtcatttactgcatctttgggcctgtaacttaaatcactctacgtgccatttccttacctataaaatggcgggggtggggagataattataccacctacatctcagagttttgtaagaactcaagtgagtgaatccatgtagactgctgagaacagtgcctggcacagagaagcagccttcaaattatgctgacacaaccacttctatgccataccctttgacatctgataaatgttactgtaacatttcatataaagtatcagaatatggattctgcctttgtagggggtgtgtgtgggaagggagacgagggaggagtcagatttttctgttcctatccttcaaaaccacaagctaaaagctatacacctaggtgaacactttccatttccaataggccttgtccatttttcccttctcgatggtttaaaatggttcccaggcacacgtgtaattaaattcattatcttaaaaaactgcttcaggaaatgcagcaatcaaatctgccaccatctgttttttatagatagatataattacaacctaataggcatcatttaatcaagacttaacaattaggttcttaaatccaaaacttgatcattttcttccttgatatgtgtacaaaattttctcccaggtggtggtcatgtaaagtgaaggatggaagaactattaaaacccttatcataatggccttcctaaagtgctaattattacacaattaagacagacataatatgactagaaagcctaagaaaatctaatgcaatctcacagaagctttttaaaatttttttccatctctatctccaaactacctaccaaaaaacccaaaatacaaaggagtacctctcgcctatgacttcttaacaagcgaagtcaggagtagcaccaaaccttcccctggttctaacatcacctagtcagatctttagaggagaaaagcaatcctatctgttaccttgtttcccatcccgcattttaagagataagaaacccaggacctgaaaagtgagtattttcctaaggcactcagggtgaaacctggactagaacctagatgtccctccataaaaaacaagattttgtactcttactccaccccaccacgtgagtggggaaaagcagagttttgagggcctacaatcctcaagtctgatcactgggtctctcacatctaattacaatatccagccccatttccaacttaataagattaattctttgtcactgatgctcaatagtaactcttgctactcccagcagccaacaccctagtttgaaagacatgcaggtcaccagtgcatcttctattgagagcccctaattgccttaccacacccaaggtgcttcctgctagactaagcttctttacagacctaacacaccaaataagagaccacagttgggcaagaaatctattaagaattagaaaaccctgaaagggctctatttaccactgaaaagaaaaatcttaagccctttgtagtttcccattctctttcctttcccaaaagctttaagaggtctcccagcaaacctaaaccaagccctcacttttaaacacagctgtccaaggactctgtgggtgggtgcaggggacagacctaatctttccctatgcaagatttgaagagtattagagaaacaaagcattaaagaaacaaaagccttaaagtccaatatttctcctaaaataacctcattaaggcaagttttctttggtcttccaaagaatcccaattcaaaaatgagaaaagaaagtagctaataatgagggcttcaccataaagcatcacaatcaacctttcattattcccattctgtaggtcagacatcgaaggcttggataggtggagtgactttgaatagggaccccaaattctgaactggaggtgtaacaatcaagtcctaaaacagtagagttcctattcctcttctcagcttattttaacaccaaatgtgtaacccagggtatctgctcatgcaggggcctaagtgcacccttcacaacccgggatggtagtgcccaagagcagctctactaagccagaatgagcaaatggcaccatgcttacatgaggagaaggacctcacaagctgcagaacatgtccagcctagcccccttccctcttattcaaggatgaagtgaaatgcactacagccctatatgcttaagatatcagatggaaattttaagaattctttcaaagaacataggtcattatccccaactttggaaaactacttcagattacttggttttggggagtagagaatcagtatagaatgcttctcaagcaaatgaatctacaaaattagaaaatttgacttacttaaaataacttacagtaaaagtttaaaactaaactttaaatttagtttgggaaaacagatgacgtatgaaattttttattcaaatacgaatttagatctatcttcatctgatacgggtgccttcaagggcaatgagccgctttttaaatctcctcagaggatcctattcacattaaacagaagccacaggaaaactggcattaacatttccttcctgcttgttggaaagcaaggcaccttatttgagggctttccagatcaagaacacattttataccaataaactttacagctgggcccagcagagatctacaaattaaggctaattgtgaactgtacagcaactgtccttcgtcttccatttttatattttatttcaatttggagctacctaacagacacagaagccctccagactatttctcaaaactttctgtttggaagtaggtacacgcacccaggaatactgaagtatgaaataaatattaagagcctagaacaaaatacaaaaacattactggaaataggctcaatatgttttaaaataacatttaaaacttaactgctgctttatttcttttaaactcaaagaaattttctcaggtagaagattttttaaagctacaagggatttcaaaatgaaaaactaatatttcttctcttgaatgttgtgcttgaaaggaaaagttatactgtcattcattcaataaatattaagctctacgtacaggagctattggaatataaagtgtgtctttgccttcaagggctactcagttttcagacaagtaaatttcttgcaagcagaaatcccagagtatcaatgatctcaccaacagaagtgtcctagctaagggactttagttttaaacagaaatcaacatcattaagaatgctagatgtcactgttactgacatttcttgatccagttagggtgtataaaggtcaacatctgacaacagaatgttcacgcattagttatccaaactaaaatgcagaaaatgtctaaatcagcacatttgaaactagaaagaaattaattctattacaatattaaatgtggaatcatacacagaaaaataaatgggcacccttcactaccaacaccccattttgcattttaaagggggaagggactcccacagagttttcttctaacaagcgctgcaaataggaattgacaggtggagccctgattgacaatggtggttttagatgacacctcacctccctcctccttacccacctaatctcacgactaatgcgggaagctgaaataaatacagtggaagattgtttatctgtttcgttttgtttttttaagtgcagatgtgttccacaattgaagaaagaggttaagattctatacacatcctgggtaccatttagtcaatgtctacttgagcaacaaactaggacaatgaaaccaatacaggaagaagaaaatgcatggagcaggtgaactactccgaggtgcatttttagctcatgtgaccttccaacgtgctccaagtatgttgtatgtagatgtgtgggcatgtatttatagaaagggtcaagagcgctataaaaaatacattaataatgttagtgctacaagggacttccaaacgctagcccacagcctcaatttttagacagagaaagcaagccccaagacttggccaaactttctagtgatagaatttgctagtgatagaatctggtcatagcattcaagttttcaactcctgaagacaatcttacctccaaagtactccaattccacagctttattcttaaatttacccctcccctagaaagatgactgcccactcctccctacaatacagattccaagttttaagactcagatgggcctagccctgccttccaagaatccattaggctaatccagtggttctcaaagcatagcctgggaacctaagagtcctctgagacttcctcatacatccgggaagtcaagagaatgccttttcctctcataaatgtacagtagagctttctaaaggttatatgtgacacttgcttctgcattcagtctgttgcaatgagaatacagttgactagatctattaagccagacgttaaagaaatgtaaaatgtaaaactatgccagccttactttttaaaaatatacatattcctcactttaaaaatattttttaatatgtaatgggtttgctatttaaacaggtttttaaactttctcatcttaatttcttatacagtaaatatttatacacataacaaacaaaaggtcctggggtcctcaataatttaagtgtacaaagggatcctctgatcaagaactttgagaattactggtctaattcactgctacataagcatgcctttatggtgaatccctttagcccatatagataaaccttagaacagcttccaactactctccttaccttcaaagggatgttcctccagctctgggactatgtaaactacttctcatgcccagtactaccctgatttataagaaaaaaacgtgaatcatctcaactgcctttaatgtaaaatttttacataaacattgtcggggaaacatgaatataactgtatattctggttctcagaaaagatgctttataaagcataacaagctattacatgtttcatgttgcatacttacactggtttagaaaaatgcttgagtatcttatgagtctctcctacacaatacaaagcatgccagaagcagtttttcactttcatttgggggtttacaccctagtcaggaagccatgcatgctccatcttcctctcaaagccctggtgcgttcctcctcaaggcccctttagccacatcagcccatgtcttttgcttcagttttcctcacactaagccatcctgtaaaattgtcccaaggctggctctctcaaacaaaataagagaaatgttcctgtatggatttcagtgtcctctagaaacccacccatgttccaataatcaaaactttttccttacatgctaggagtacaccacacttaatcctcttctcctggggggttgcgggtggggtggggggacaagtccccctatctgtataaaagagcttcacaagtgctactacatctacctggtttcaggaaccttttcccaatgtttgcagcagacctcaccaaactcccataaactcacgttttcttcctctggactgtcaaccagacttggagaacttgagagtggcatccacatcctagtgtttctgagcacccaacgaccatgcacaacgctcagctcaaggcaggcactgaatgctaacaaacagctcatatgtaggaaaagtgcaaatctattaaaatgctctgaaaagcccaagggggatcagcttttgaagtaattagtaattctattataataatttgtgcaaattaaaaaatatatatttgatgcaaaaagataaccacagaactgtttaaaagatggatttattatttatttatttatttattttttttttgagacggcgtctcgctctgtcgcccaggcaggagtgcaatggcatgatctcggctcacagcaacctccacctcctgggttcaagcaataaaagacagaaatatttaatttcttcaaatctacacctgagaggttaacaatttcatgaacactttgaacactttcaaagaaaatacaaacatgtaatggcacaggtgaggaaaagtaaatacttaatacatagatctttttgaatgctctctgaaccttgctttttacatttcaagatcagcacatactctttatttacagatactatataatagagatatataccctgattaatttaaccaatcccctactgatgaacattccaaggttttgctatttcaaacagtgcttacaatagataccttatacagtaaagcaaaaatgtaaatttaaagatagaaattgctggtttgtagtctatttgcatttttaattacgctagtcactgccaaaaaaaacttctgaaaacttatcagtttgcagtcccaccaaagcataacctacatttttaaaaaggaaataatgcagcagtgtagagagggcactgggggaagtaaaggcaagtcgggaaccagccacaaggtcacagtcaccaaccacaatcattatacctaagactttagacaatacatcttagcatcagttctgaatgtatatgaaatgagactgctgttcaacactatgggtagggcctttccagctctaacattctctgatgtccttgaacttgttatatataagaaatgtacattaaatatgaagacagaatgcttatcctcttggactacccaaggacaacaaataaatgctgggaaagtcagctgcaacactgggaacataaatgctctgacaaacccctgctaggaatttcaaaatggaagtgaaattgagactgaagaaaaagaccacctaataggaaatataaaaagccatttcaaaaatgataaacaaaagaaagacgttaatcatttggggattttcctagtttaaaacaaaccacatctccgtaaaagaaatatggctaaatggctataacaagtaagggccaaagcaccctcatggctactaataaataaaacggtacaaacatccctttcaagtctaccatttgagagagtggatactaacaagagatatgatttgctaagctaaataaaagccttcattaacaagaagtgacaggatcacaaccctgctgctgataaactgccaacatacccaaggtcttcaatgaagggttgcccatttaacatactgcagctttaaaatgagttgctttagaacgaacagttctatgtcaaggcaggcctacaacatacaaaacagatggagctgctactgtaccttgggcttgtgtgtgtacccatgcacgagcatgagcttggcatataccacaggagaacctggcccaataacgcttcttaaagttagccatccatgattagagcatctaccttagacctcaacttctctatctgcttccaaagatactcagtgtagagcagaaaacattcttctgatagccgaagagggttccacatggctattaaatgactggcccagtggtcatccatggagacccctccttattcctggcaaacacagtcatttcagtccaaccttgaagcagccaatatcttttcaatacagcacactttgaagcggtattaacaggtcataaatacatgtaaaaagcatagtttcagcttagtcaaagtggttacagaagcatcattgtatatttttttctgggtggtccaagtaaattaaactcaccaactagactgcaaacagataccataaattcttaattattcacaggtatggatgaaaagaaatagcactttaataaagtcatcttaaaatattattcagtatccagcacttaattaccatcatatagtagtgatatctaaaaaacatagaaatgtttgctatagtttaaatattaacaatttttattaactccaattggttaaatatgtaagttatacaacttcatagcaaccaaaataccaaggccgaatacacaattaaaagaaaaaaacttgcatgtaacatttaccttcagcatatataattttaatcttcattttaaagacataggacctattagattcaagaaatcagactagccaggtgaggtggctcaggtctgtaatcccagcactttggaagtccaaagcagaaggatcccttgagcccaggatttcaagacaagcctgggtaagatggtgagaccccatctctacaaaaaaatttaaaaattagccagttgcagtaaagcatgcctatagacccaactactcaggaggctgatgctggaggatccctaaaagcccaggaattcaaagttacagttaactatgatcatgccactgcagtgagactaaatctcttaaaaaaaaaaatcagtaataagacaataagacccactatattcagaaaacaaagttataagaatcactgacatcaaagagcttccaatgtagttgaaagtaacatttaagttgtgccctgaaaatttaaaccaatataaaaagctattaaggagagaccagacaccaaaggcaatgggaagttgttaccccaagtgcccattccgtaacagctccttaactctcatacctgctgtccctgtaatgccagaagtaaaattaaaattctcctctcctgaactaaaacttggtttacttctctccaaattccatcaagagtagaggttactgtctatattttcagtagcttccttctgcacctaaggaaaaggggctgaaatctaaaagctgtgatgaaataatatccacctacaaaaaaatgctatatccatgttaaatcaaacaattataaatggtataagctaaaaggcatgcaaagtttttattatcttcctaaagaccagcttatattaaaaataaaactgtttgccagagtccacctctctgaggaaactaagagcctagtcaagtaagcttaataatctaataaggtggtcagaaagacactattttaaaatatcatatccttgccatgcattcactgtactgtttaggtctggtgatctgtgtgaatgaggaaactagccagatggaaaattcacttcctcattttccttaaccttttttccgtgtcttttccaattgcttagagtaatttcccatattctacccatctcttacgaacatacctagccctttaggattaaggaactccacagaagccactgacatttttttaaaaagtatttttcgacactcttaaacaacaaatgtcttccaaagtttctacaaaaaaaaaactgcctaagtctcttccactccaacaaatattttaaaaacaattccaattaatatggtatttccttttagttataatttaaatgaatactggaaggaacacaatatggtaaagcaatggggtgatctgtcaaagggattatctaaaaggtcattcataaacaaaccaaataatccaatcaatgacaaaacacaactgtggatgaattagtgaaattctaatttccgccaagcaaaaagcctaacaaatattcctaagttcttactgcatcaattaatacattagaaagtgttatttaaacaaatactgataatatttcaaaatccaacacattttcaaagccatgggtaaagagaataaaggatttagacaatgcagatctcactgctgggctttgcattcaccacatagctttcagagtaaaagttgccaaattacgttgtcctgcaaagaacattaaaatcggtttctcgtaaaaaatataaaaagccagatccatggtgggatagaagctgggtggcaggaatcagctctaggactcaaagttcaccatcaatttatcaaggagaatagagtttaattttaggacctctgtctatccttatgcctataaaattaaaaactagtctgtttttatgtacagtaaaaataaggtagctaggaaggaaatcaacaaatgatcttcactaatcacctcccacactgtgttataagccttaaaggttattttccttcacagcacaaatcacaattatatgtaataatttgtagaactttaacataatatctcctccaataaactctaagtttcatatcagcagggagtatactgtattcactactatagtcttaatacctaaggtagtatatgtggcatatagcaagatcacaaatatttactaaacaaatgaaaatctgcacaggaaaccaagaaatgttcacatgtaaactggcaaaataattgcttttaaagtactggggggcagaaaaggctggatcagcaaatcaaaaactgaatagaaggacaatcaaaaagagcaaaatgccattcatgtcaggaggccagacacaataaaataataaaatgttaaatgctaggaaaagagagataagtttaaagttttaaagtggctactaataaaaactttagatgtaaacatttcaaatattcataggctatttaataaactgtcatcaaattgccacatttctttgagacgataacagagaataatcacagggaatgagagagagaaagaaatgttagccataatgaaaaattccttatgggtaaagttccagaaaattccttaaggagtctgaactataacacccaaaacttaacaaagtccctggatctcttaatgcttctgaattccatagggaactggggagctacaaagcattttacccaacaaaatctctggtagtcttcgccaaatttaaggaaacacaacaaaaattaaagagaaatgatacgtattaaggtcaaagtttaaggttactatgtcctataaaatgtgatgatgagtaaaatgctattgagctttcaccctcaacaattaacttctgcttcatcctgtgatattctaaattacagctaaccagtacggagcagccttgtcaggatcccacctgactgctttgtgcatagcctgttggccaattttataccagaggcacctgcttgaaatatgtagagacaatctgatgaccttattttctcacgtttacaccagctttccatagcacaaggacaatatttatactctaggaagagtaaaatatttgcagagataagaaatcagagaacatgttggcatgaagctatttcagcttctcaattctaagacatttggactgaaagatgcacccactaacctcacagctttgggggacatagaatcaggacattaagtaaacttaagagactcaaaagtaatataaaaattgcatatctaagacatgagaaaacatgggattagttaaggcagtttttgcaaaaatttccctgtagagattgaaattctagtaagattacctatcattcatgatttacttacatatgcaaataattttcaattgattatcagtctcatgtactatattctttctttaaattattatctctattccagacttttgagttctgctgttccagtgacctccacaaattttcctgaatttctcctaaaaacacactatgtgagagatcaagtaatgaaaaagagcacatggcctctttctagggaagagcaaaaaggtcattttgaatctgtaattctttgtcatccactcccaaccaatttttctgacagtaaagttggagaaacagtaaagttggagaaatactgaaaacttactggagaaaggtgaatcaagaacaatctttactgggtgaatattttgtttattccaatttggatatcaaacatcctattgaacacttgacctgccatttttttctcagaacaaaaagtagtatttctaaaatcctgcctgattgggaacacattttttttcataaacttaacaagttcaaaaaacagcccttacagattatctactacaatgagccagggttatctcaatgtcactttcacctttttcttgattttaacagcatcctaaaaaaagcctgaagacagtgtcttcatttccttgcttacagaaaataaccaatccatactttgtatggttccaaaaagtaatcctgcaagtcaaggatgccagctggcatcagaaagtcaccagcctgtgatggaaatgcctccagaagtcacccagtcatggacctaaaataatccaaggtcagaatcctggccctgaggaacaagttgtgggcatactgctaggagtgctacagggaccacagtgaagctttaaaaaaaattataaaaataaaaaataatcctggtacaacaaccccaccactggggaaccaaacagcctctaaagcaatttaatatggaggtgagatacaattgctgctggagtcacaccattttatttcaaaacacccctaagagaagcaatacattctcaaacatgaaaactgagttgcttcttggatctgatttcagccaccttaaactacagccagcagaactaccaaaagtagaaagaacatcattctgggatccatggaaagaggtacagaactaggagtctgacctgatcctacttccccacttggttgtatccttgggcaaaccacctgacctctgagcttcattttcctcacctataaaacatcattcccagggagctgtggcaagtttctataaggacagaaaaacttggtgttaatcaccattactagaggaaatgctccgtgtctcctggttccatcaccttgtggtagttcaccatcttcaattgccaactccacgtatttttctatcttcctaatggtaagtcaacaactaaaaagtggcagatccctgctgccccatcccaatccactgctaacttgactgtccaacacaaaatttcttactgttgcattctcaagggagagtcatttggaagttaccatagaagttgtacaaaaggaaaaccaaaacagatgtcttcactcttcctgtctaggtcacaaactattattcactctaaaaccaaagatttcaccctaccatccacaaaacaatgtttataagtcagccaaactgtttgggaaaaaattttttcaaaaagtccaagaaacaagaacacaaattattccccgaacagccagttccaactgaaggaatgagcctctccactaaatcaaaaaggtaacgcagcgtacaagctgttcgatcacctttcaaggaaaaaaaaaaaaacccacgaaacagtaatgcaaatgccattaagggagaaaagcagtggccaggcctcagaacaccaagcactggcatgagaaagccatagtcagcagcccagacaacacatgctcctggaagacatggccttagccatgaagatgacgcaaggagaaggcatagatcaatgctctgaaaagcaccccagcttctgtcctgttacttgcttcttgctcctgcaactatattcccaaaagggaggaagtcaaaaaagttgtaattattttgactttttcctaggtgttttgaaaaataaatgttatacccagaggaggctgctggcacataatgttgtcaacagaataaaactctgggggaaacacccagcttcatgtagtttgaaacacaacgtgcctcagatctactcttctgggacaacagtggaattaagacagtcacagcttgtctctctctagccacaccctcaaacttgagtaggttttgcagaaatacttttcacctgtgactgagctcctggcaaactaggaaatagttactcataccataaaagaaaatcaaaggtaacaaaaacaatatgggaggaacgggggagggaaataagacataaaaagcaaaaaatagacaaaatggaccaagaaaagacacagtcctgtccctaaagcaataagcaacaacctggcctgatcccttgattcccagacaacagggatatatctctttgcttaattcctcaagcactcagtttctactattaaatgcaagagtggggagtgtgtgatttttttttaagttatcattttctgcctcatctccttaggtagagaccaaggaatatgaggtaaagggcactttatacaagtctcaacgttctcagtatccagcactcagtaatttgtgatgaaacaataagtattacacaatcttcctggcttctgaacataatctcaacacaaaacctagaagaatatttttattgatccttcaacaaactcaaaaacaaaattagattaatttggaaaagccctaagcttcaagttaactagcagcccacatatatcaaagtcattcttattgcacagtagaagctccacgggaatgactcccaatctttagggggataaaacatgcttgtttttactgatattcaattccccaccccaacccagtaactaagccaccctgaggtgccgcaatgagatgctgcagggagcatcaaaaacaagcaacacgttcacctaaaagaatcatataatcatagaatagaagatgcttggtaccaagaatttttaagtgcctctgaaaaataagttccaaatgtacctacaatgattttttaaaatcatacacagttaattcaaaattaagtttttaagtgagcatacacttatactaacactccaaatatcaaaaaaaaaaaaaaaattggctgggttgtagagtaagccaatgcttaaaactgccaacattaagctattattctgaagggttttgctaagatgttcaatacaggggcacattctgattcatcgttataactggcctagctgaagtggctgccaggagagcagggttttatgggcattgttccatcctaagaagctacattaatgctgggttgatacaacagatcttcatatctatttaccaggctgaacaaaagttaactagaaatgtaagtgcttaaagtcaccaaaaggaaggctccacactgacattttctacctacttagcattcaactatattcatctcactagacattaacacacaccaaagttgctctctgctattcaaattgtgctattatgctcaggagtagattaatattatccaccttccttattgtaaaataaaattacagcattggtccaaacatgacatgtggagcctctttctacttctgctggtgcatcagtctgctctacggcacacataggagagggccttgctaaggctgccctgctgcttctggagtgggggagaaaaggctgaagactgaaaaaaataaaggggaaagggagagaaataacacacacacataaaccacacacctggaagtctcatatcggctttttttttttttttttacaacaatcttataaatctgttgtcatttataagctcacaacatcagcaatgaggttagcaggtgggccacaggcctcttttaaacagctcataacatcctatcagtttttacagcatcaagtagcaatgttgaccccaaagcatctgaataaatagaagcaggcaactggcagggagaaatccctactcccaatggggacagttctaaaatcccagggggggaggagagaaaaggtaagttaagctgagagaagctcattttataaaaggagaaactgtttttcaaccacgggttaaggaaggagagacccaagacaaatcttctctgaagtaaaggagactataagatctaaatatgtaaggagcagtttaacatgattcaaacattatctgtaaatacaagagatcaaacgaatataaaacctttagaactactgcctttgtctttacacttaactttttaattcacgtggctttaggaagtatagcattagagacaccaaggccaggcaaacaaaccaaggtcaaagtgaaacaagccatgcttcatccttaaggcgcagtcgataaatgtggactccattgttgttgctccatccttccaagttttcaagaagcaatacatttggctccagatctttatatattaccaaaccgtaaatcaacaactcacaactatttaaaacacagttcagggcaatcaaaacacctataggccatatgaagctcacggatcacccttcaggacctgtggcacaaataatttgtccactgataccaactgctccttctggtatcagtgattcacttggtcacagaagatattcttcagtaagtaaaatgtaacaaagtgcataagagccaatgcaaaagcccaagcaggataagaaaataaagggacaagtgagcaggttgcacctgaccccaaattaccaggacctggaactaagcacaaggctaaaaggataaacaagggacagagggcaagtacagacgcatcccaaagaggggaggaaggctgtgggtagttcaaattccttgcggagactatggagaagggaagagatgaaagtcaaaagcactgatgacctcgtatttgggaaaagtccatgggtcattcagaggcacaggacagaaaagaccccaagggtttttaaacaaaataagccagcaatcagtaaatagcacctggggagatcaaaagtggtgttgaataaactcaaatagaaataggccttacctgggaacaggttataaaatcttgctccctctataataaatgttgtatatttaacacattctggatacctctgcaataaaggtggatgaccccctcacctgccatatcacctccaataaagcaatatcagtataacaagaaattcttacttttgaaaagcagctcagagaaaacaagatcaagtgctccagaaatattttcccatccttacccaattcactgaatttattttcagatacactgtgatttgctttattctgatatacacaaatgatgcctaaagaataaaaaaagtgctaaacatcctttaaaagctgaacaagtgagcaatttccaataacttacttgacagggcatccatcaatgatgttcacaccatcagcaatgaggggaaaaaaatgtatttctatgtaaactccattttgtgatgtataggaatggatccttgataagaggttaaataaaattcaaatcagagaaaacgcggactattttaatataaatggttaaatttaaaattttgatttttcactgaaaaaaatatgagaaatttaaattaagaaatttatattcctggaatgttagctggctaaattctcagtctcatatgtaatcttttagcattatttatattttcaaggaaaatgcattttaaactttccaagtcccatcatcataggtataaatatgtctatttccatactgaaatgtccaaagtcacaattctcccaaatcctccctgcagtctgggatttttcttttacttcatggcagaaataaacatatgatggtgtattataaaaaaacaaaatcactaaaaatggttcataacacattgaaagccaaaaatataaaactaatcaagcagtaaccacctactaccacctttccaattcagtcaatgtcatttcattgtcaaaaaatcttgtacttcaatatgctcatctttacgtggtccttgagatggggagggtaagattttatacacaatcaaaggttaagaaaccaaggatataagtaattaaaccaaaccagatgctgaaaacttcagacttctagcctactattttccacctggctgtgctaaattaagaatttcaacctaagtgacaaaacctactgagacaactcagcaaattggccgcacgggcacggtgatcacaagaccttatgtgtgtgattatttgtttacaaaaacagaatggattttaaaacaaactatgagacaggaaagcttagagtcagtcatccttcaaagaatgctaaaggcccacatcactaactcaacagcagacaagaacctctgaatgacttcacccagttctcactagtataagaagacaactctaattgccaaagtcctatttcccaaatggaacctcattttaacacgctttcttccaaagtgcaaaatactaaaaactgtatggaaatttcttatttgtatatatttctctaggaagagacagctacagctttcttcaaatgcttaaagagattctagcccctcaatattaacaagaacttccaattttacaatgactctaaagaaatgcaggaaagctaagaatctcaaaacaactatcattccctagtcccataaagagatgaaattagtcaagaaagtgtgtactaaaagctttcagtaaaaaaaaaaaaaaaaaaaaaaaaaaaaaggggataaaaatccatcttgaaggaatagtttattgctttgatatttataaaagatttttgtgatatcctattaacatagtctttaaagttgctgaaataatctccaataatgaacaacccacaaaaacaaaatgctggaagaaaagaacatttagaatataaatttccctttcatgataaactttttaagtcaaaggaaaaacccaaggattaaatctatcactacagatggtccccaatttatgatggttcaaacttacgatttttcaactgtatggtgatataaaagtaacacacgtttaggagaaactatattttgaattttgatcctttcccgggctagcagtctatggtaagagactctctcgatatagggcaatggtagcaagccacagctcccactcaggcaatggatcatgagagtgaaaaatggatactctgtgttgccagatgattttgcccaactataacataaatgttctgagcatgtttaaggtaggctagactaagctctgatattcagtaggttaggcgtattaaatacatttttaacttaatgccattttcaacttgcaatgggtttatcaggagcatctgtattagattggccaacggaaaaatatacaggtacatcaaactgtagataacatacctggttcaaaatataccagtgctaaagcaaaaccttcactgtgtcttaaaaaaaaaaacctatcattttactgttactgtcttacagtaagtataattttaaatttgtcaagttttttaaaatacatttttaaaagtgggaaaggggattttgcatgtcagaccttatctcctattcattttcagtcagaaactgatgtaatagatatcagtaatataaatatatactaagaaactgcaagtttatttaaaaaaaagacactgtaaggcattctataaactggtttagttttatccccattccacctattcttatgactttctgggttattttacctattttactcctcaaagcccccatccttctcttcataaagatttcttacaacgaaaacctgtatctgttgtcacacagaactattcagcaatattcaaaaaggtaccatgtcattaagcatatcaattcagttcacgcattgagagcctaactcaaagctctgagaaaagaatgctcgttgcaaaaatagttatttttattaagaccaatctctagaaacttaacattgatattaaagatgaagatgtctatgagaatgcatttagcacagcgttgctcacacaagagttaccttttgttttgttttgcacaatggaatacaagcttagagataaaaaaaattcttcccttgaaataaaaaattcttctagccttactaaaatgaaacatatgatacacatcacacaagctgaaagccaaatctgttaaatttactagtgaaaaatgtcctaagtaccccacaaaaatctaagattttattacgcaaactttgacttttaattcagactccaaaagttatcatttaaatcataataaaacacttatcttttaatatgtaaaagccttaaaataagcactgcctttcaagcttaagtgtcttctgtttccacttggcaaatttacgttatgtgaaatccttaaataattaactagcactataaaccgtctagtatctcgaaccaaataaatatacaataaatgttcttcccaaattagaacatacaaaagtgtggatttggcactgaactacaatatgtgggctctgtgcgtaaccagaaccggtgaagacttctacacctgtaaaatgaaaatggccaaagcaagaaaaaattttatgcattttatgtcctccatagtgaatttgatagtcaggtgtggcatcactagacataaagccttcaaacagttctataatatatcaacaaagcagcaatactgacagctaaatactaacaagtgggaaggcaactaaccaggaaaagctacgtaatctgtgggtcccagtgcaagatgaaaatgcagggtaaccttgtccaaaaattcttaagaatttcaagattgggtaggatgtgcaaccataccggttacaagctggaaaagcagtcctgcccataactaagtactcacgccaaaaataaaattaacctccccccacacacactcaaatgtggtagcttactatcatttttgacctgtccagctgagtagccaagaaacaaagagctgggggtagactgagatgggcaggttttccacagggtggcacaccatctagcccccttaaaatgtcaacaaaaaagtaaccaaaccaagctaagtaccacagattctagcctctctcaattccaaataaacattatgagtgataaaagtggcaataagaatgtgacgatgtgatagatttaataagacatcaaatgggagcgaaaatactgatgctaccatgcagacaagtcatcaaaaaggggaatggtaaagtcagtcttgataagaagcttaagaagctatttcagagtatctagtcctttggggaaaaagaacatgaaggctaatttgccactgtggtgctcttgtgcaatgccaataatgcctgaaaagcgtcacaggttttttaaaaaaatgtctttcagcaaagaaagaggaaaaggttgatcccagcttaaaagtcaggatattctggaaggctttgctgtgtccttaaagagaacctaagacttgcttctagaatagaagtggggtggcaggaggggaggcacattatttttaaaagataagcagggaaggctggaagagccaagagcggttggttacaaggattcagctagcagcatctgtctgtgtataaataatcaaaaggttgattcaaggaatgatggtatatgacactcacagcatcattctcccttaacctaccaggagctgagtcttaactaaaaccactgaaactgggacagaaaggctttgtttttctcttgtgaagaggcggtaaccagaacaaatcaaccaaaaaaactaaatcagagaggatctataaaaacacatcttaggcctagaaaagaaaaaaggttccatagtaaccttttgacactgagtgtcaaaagagtggtagacactgaccagcagtgggtacttgctctaaacaagaagcatatcctataactaaaattatcttgaaccacagggaaagtgtgtgagcactgaatatagctgacttgattgttcctgaaagaagacactacacaatgaaggaaacacctacagataaggaagagggaggggcttaacacctaaagttgtctttcaaaggaagaaaaaaacaactaactccctgaaaggtggcagcacaaagttacccaaataacaggcaacaaggggctggttttaaccacacaaaaataaaaatactctctcaaaaaggaaaattacaaaggaggaatcacagaaaatttaatgtaacatgtttcttcatattctaatttttcctaccccattctggcctttatcttccagatgttttcttcctcttctttctctccccatagtttgcaagcgaacttcccgtaagtatatcctccccacaaccttaagtgttgttaccttagcatccctacaaacctcctataaagaaggcccctaccacaaatgcagtaacattcgggtccactcagcaatacagtcaccatttatatatacccaaaggttactaagacaaggtagatgcaggacagcttttccacccgctcaccaaaatggaaactccaggtcagcttccacaagaaatgggaaattcaagcgactctggcgaaacgattcttgagaaaactcttcaagggcaacaaaacaatatttcaaacaaacagattttacttgagggaatggggacattacacagcaattgatattcgaatggttttaaatggactgattcgccgtaagttttgaggctgagctaaatttttatgaagaattattaggaatagggccactagaaaattaagttttaaaagcgcttttgtccttgccgaaggtattacattttggcacttctaagaaccgttctttgagggagggaataaaggagagtggacaactcgtagcaaatccttttcccatgttttcagaaaatgtagagacgataggacttgaaaatctttgtcataaagatggtctttaaaaatgcacacaattctaaatgaccatctgggcagctacaactgcatgctcatagctcgcatctagaggcatggttttacgctctggccctgaaggataacaaggaggcttttaaggaaatgccgtgagaaagactgctggctaagcattgtcacggccactggaggagcacctgccagtgaaccgacgctggctcccccagtctcaccagtgcacgcacactagtccgtgcaccccggccgccgctggcaggccctaccagccaagctggaggagcagctgccgcaaccacggcaagcgaactgaaatcccagagccggcctcgcccggcagagcgcccgcgcttcccgcgcagcgcacgcctcgcgcgcaaacccgagatgtgaccgcgagctgcgacctcgcgcggctgcgacgggcctcacctaacgcgcacgaggggatcatcattgctcctgccctgggcgcccgcggccctacaccacctccgcacacaacgcggccggtgttaagtctccaaacgccccgagagctccaaggaccgcgcgcgcgaaggcgccgtagcaagtgggcacacaccagacaccaccccggcgtgttccgcgggagaagccagtgcacacatcctcccgcaaggcggggttgccagtgcaacacaggaatcctgccctttttctagaaaagccccctcccccactttccctccaatacactcacctgcgtctcaacagtttccttcttgcgctacacgcggccgcacccgggcacgtccacgcccgtgcacgctgccaggcgcgactgtccccgctcggctcccgccgcccccaacctgcttgtgcccacgggaggggcggtgccacctcccgaggcgcccaattctctctactcccgccgcaacgggctgagctctaggaacttcgcgggcacaacctccgccgcccccaccagtgttcccgcccagagttcggactagggcgcaccacccctaccctgctagacgcagcgggggcgcgcacagaccttagcctcggcgtccaaaatggaccaggggcaaggcgcggacgccgtccccgcccccacgcccccagcacttgcctgctgtgactcgaagctgcagctactacggctcgtgccgctggccgtcagcactgccgcggaggagtcgctcggggcgagctccgcggagaggcggtggcggcggcggcggcgggaaaggggactggaagccggcggaacccccgccccacccgcgccgcgccgcgccgcgccggcaaccgccctcctcacccggccggctactgcctcagtgacgcccaggcgccgcggtcccgccgtttgtagcggggcgggaaggaggggcttgcttggaagagcgccaggaggcggggccggcggcgagttcgcggcgccgcggccgccgccggcgcgtgccctgcccgaccgcccttcgggtccgtgccggcagggagatgccgggcttcagcagctcagctccgtccctccggacttccgagtctcaccaggcttccccgacaaggtttctctggactcggtggagagcgttgagcgcccagaggaggctgattccaggtgcaagtttgcaaatcccgaggcccggggcgctaacggggagtcagagcagctaacgtgggggttactttatgtgttcataaatgtatttataaatatatataagtatacacacatatgtgtgtctcttttaaaaattctctttttccccctacttcgcagccaaggggtcctgtccctggacagaaaataaaggcttagccccctgctgcccctccctgcctctctagagagaacctgacgtttaaataagcccagagtacctgtgcggggtgctgtactctgcttcaaacgcaaagtaggaaatcctgcactcgactatgcaaacgcttgccgctagccgcatccttctatcgccccccaactcaagacccgaaatggccaactcttcaccgagggggcgtcccatcgctgccttgccttggcccgccccttcgccaagctcaatcccttttccccagaaaaacctgtgcctgtcctcagacccggccccacggctggaagtcaaaacccaccccggagccacgcggctggagcacgtttttacacctgctcggccgcttaattacgagagcacctgtagttgggatttttttcattgcaaaggcatcgattttagcccttctcctaaaatactacatttaaaaaatcacctgtcatacctacctgaaattgtaggaggtaagagaaaggaaccgagcagtgggcgacccagtcgccgcaagaacgtgaccgaggttacagcttcaagggcatgatgcaggtttgatgcagcaaggtccgctaagggcgtccagcgctccccgcccccatgcgacgggcggagcggggttggggggaagggaggggactcgtctaacccagggcgggtgtgggagaggcaaatttgccctcttgggcgaagtctaatcagcatagtgaagtagggggctcaaccaaggtcaaaagcgagataggccatcccttaatttgtgcgacccagtctggggacaccggatacagctaactgattctatatcagcatttccgtgtcaccccaaatccgatttgcaattaaatgaccttaattgactttgtgtgggttcctgggaaaactgctcaaagcgcctgcgcctctttgacctctcagtaaatagttaattataatattctcatcccaggcacgcgggattgctaaaaatgcctatttccaaaacgttaggcgaaaatgggcctacttaatttgtcaatccaaacctaaaactcttagaatgccctacgccctacttcctgacgctgactaaattatgggagagctctcagaagagttccccaagtcttccaaaccacttcttcctacaaccgtagcgttttttgtgaagagctccagaacaggttagctttatgaagcggggtgcccaagcacttggttaaaagagggaacggggaagaagtgcctgctgtaagacacattcaggcaatgacagcaataagtaagggcgagagttaaaaaataaaatgttaaccccataacaacttcgaaactctcaacatatttttttgcgggcttatctgttcatagtctgacaaatctttcagatgtcccatttaagaagccattttacaaggaagtcttaaggcccaaacacatttcctacccttctgttccccaaaacacgaacaccctttttctgacctttagaaactgattttcaatttggaaaataatttctttagttactattgtctgctgtgtactttctaaaaattttcattgtaagtctacgttttataggttgcagttaatagtgtaggcctgggaaataaaacattaatctccctcccacccccagaggatgggtataataaataggggtgcggagaacggctgaaggtttagaatcttaaccaactggagtgtttgtacatgagagggggaagggacagaatccgtgcatttcggggagaaagtacagagacctccatccctgtccagcagtgttaacagtaaatactaaatggttggctatttctctcaccctcgccataataaaaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacactcacccacaccccctcgtgccaataatttaaacttctcttaggaaagccagcagcttgttccaccaccaccaccccttccgccctccccggcccacgaacatcctccccctttcccacatctaccctggatcctctctttggcagtagaaagccaaatgatttctcctaaaccctgagaaatcacaaaagttaaaatgaagcgtgtgcctatctgcccagcttgtcatccccaaccatctttctcctggcgtcaatttaacaatagctattcgaggaagtgggggcggtaaggagggggtgagggctacgtggccgagttggctcctggggtggctgcgaagcctcgcggctgcagaggggttccccctctccccgaaggcgaagtcagccgcgtaggaccaaggacagggcttggaatccacttcccagcgcccagcacagcgaggctcccaagcagccggcacttcatagacacagctccaaggatcttatttacgcttttctgaacaaagggaatctcatatccggtacaggcttaagaattcagccccaaattggctatcttcttttaaaactgaattatgataattggagtccgtgaatcagagcccgcatacaatgatgagttctgacagcttctaacaaccctagcctcagcccagccccagccccagccctcaggcggcatgtacttttttcagtcaactacaactcgctgcctggtgcagcatctaaattccatctggcaatcccatctccccagcacatgctatctggttaatgcaattaagcctgtggttttcgctggtctaatctgccagtccaggcttctgattccccttaatgattgtaaagcctctcccgtccttccgttgctgagccaaagtagaggcatgcatccccaacacccaagttatcactctctccccacgaaatgaacttccgatctcaatcttgaagctcactccacatctaacctcccattgtacccctactcccccctggccacatttaccacttaagtttctgccatggacatttacgaatattcagtacgctaagcatgcgtccaccgtcttttagtctagctctttaaaattaaaaaagcagaacagtagctttgaaatgagacaaacatgtgcaattaacttcatattctgtattccgctcacttacaggttttctgggtttgccagcgcatcgctgcaactaatgattaaagaaaccaaaccgaaacttacctttctcccttaaggtttttgtgtatgtgtgtttttaaagtaacggtgcagttctcccaataaggatgagcaagaagctgctggatagttctcttaagacagcacgaaacctaaactgtgctcggcttaaaagaagcaaataaaaagaaacgctttcgaccccaaagtccaatgctaaaagaaatggcgaaaaaaaatatgaaaggggaggggaaacttaaaaaagagtttaaaaagacggagagactaccctcctattg

SEQ ID NO: 1134 - DNA, 131377 bp, Homo sapiens
tttcccttcaactttgtttattgatgtactgaacatgaaaaagtacaaagaatccaaacacaaaagaaaacatgtacagcctcttaaatactcaacagaatatattttctattccaacagatgtgaattaagtcatactgtacaacttcaaataaataccagccttacattttattaagtgctctgataaaacactgtaaagtgaagcacaatttgcatgccctctcatcaatgccttggtttgctacagtagtataggaaagaagcatgtagctgctgttttcccttgagggaaaccttattatttttttttaagtatatacatgtattttattttttagtgtttttctttttttaaacgcagaaggttaactctggcaatctaaatgcacctaaggatatgagaaagtgctaagccaattgatttctgaatagcattgagtgggtcagcatgaaaactcgcttattcactttagcacgcgcctcacagtatatgtactgtactatactgaaaaattttataactacaattttaaataataaaaaataaaactcaaagcaaccgcaaagataatgtacaactatgttatgcatagcacattgcctgttctaaggggaagcatgtgagcatctcagtttatacaaaaagcaggacgtaactatatagttctcagtgcatcctgatgaaggcatttttgccttcagcttttttgaaaatttattataagctagatgctaatcagaaaatattttgtattttttaaaatttctttcatacatggtaaagacttattttattatttccccaaatagtggtttttaagcatcatacaaagttaaatttcaatagcatacagatatttatgatttttgtatgaaaaatgtaaggaaatttgttcaaaacctatggttatactcatttttttataccacaaacatatttataaaccaaaatgtagcatcaccataaacagctgaagctagactatctacagacaaaatttgcaacaaatctgatgcactgtaaattcaagtcctcaggacaacaaaagtgattaagcaagacctcaagtaacaatgttaatgccatttacaaaggaaaaaactgatacaaaaacattcaaaacctgaacatcacttggcatgtaagggaaaaaaaattaaattagctgaaaggttcataaacacaaggtcttatttacattacacaaagctcaggtgttagccttgaacgtaactttcaaaataccttcaaatatatccaactcagatcacttttgctgatttgctgcagtacaaatcatgtgcaacgtcttttttccttaagacaaaacaattcttcaaacaatactgcaagtacatcactaaacaccatgagctctatctgaagggatttctttaggaagaacagattttttcccccatctctcggtaatttaaatttcttgcctgctcttatatattcttttgtaaattttttttatttgtttcaaaatcacaaatcaatgtgagccacctatcacataataaccaggatgatcagacgctccactggtgattacaaaaatgaaaccagcagtgtttccccccattgattctactcctttcatacaaagatctcaaaagtattttctacaccataaatctttctaaattttccaaccgctgcaaatttcctggtaaattttaaaagctcactaggtgtcatatgaagagatttctcaaagtattcaagtcaaaatatttgttccaggaccagtaaaaagtttctccaaattttcttttttataaaaatagatgctttttttaaacccacatcaaagaggctcttatctctttggcaaggtactgctttacgaaaagttctccagtattcttacaataagcgtttataatgtagcccccccttccccaacccaaatcataattacaaaataaatactgttttaaacttcataaataaaaatgtaaacttcaaaatacttttcttaaacagacataacagcaatgctttaaatgtaaaccaaacacaaagctaatcagaaaaaggaaaaaaaggggggaaaaaaaagacacaaccaactgaagaattacaacacaaagcctcaatatttactcacaggttcaaggcagttatgtaaaaagaaaagaaatgtcttcccttagctgaaacactttaaaaggtccaccttcttcaaagaaggcaatagaatgcaatgtgacaggtaaaaaccctgtacctcttgtccatattcaaacataaaagatatttaagaagttttaattcaaatactagcaataaaaaatctcacatatttcttaggatgctaagtagtcattttatccccatctcaacactgacttacaaagacatttactaatgtataaagtttctcttaacttgcctttgttgtatagttttcatatataaatggactgaggacaagagctcattaggctttgtgcgttttgtttgtcttaaaggagacctgcagtactctgtctcccagacggtatccattgaggctagctatcgccatggcagcctcatcatagtttgtcatagtcacaaatccaaaacctttgcatttattggtgttaaagtcacggatgaccttcacattggtgacagctccaaaaggcccaaacatttgccacaggatactctcatctgcgtcaggagccaggttgtacacaaatatacaccaccctgttccagggtgcccagggatattaattccagccaaactggtcattccgtcaatggtcattggagaaaacctgctaaacagaataggaaatacacacatacacacaaaaaataaaaacagaggttggttatagcaatgaacgtataccttttccatccccaagaattttagtaactctcctcccccaacaaatatataaactatttcatgttttgaccaaggtctgtgtgtggctttgcagtgacatgctagactactgagatattaataagttatgaaatgaccattattcactgtactgaatatcatccacaatagcaaagaaatatatttagaactggcttcatgaattaagcaggattggcaggggaagggatcaacacatacgtaaacatgctgtaacgtcgtaacgcaatacgaaacaaatgatgggtttttaaaagaccaggtggcatccggtggtataaaaatttcttgagtcaattgtgcttcaaagagcagcttttcattaggttgcacatgcaaaataaaacccaacaaaaacttatgaggggtgtgaatagcactcccaaaatcaaagaaaccaatcaactgtggaaagggattatgagtatcatgaacctctatcattacctctttactccataagccatattgagcagattgtccaacctgcaaaacacacatttagcaaacttcagtttttaatttttccccttgatgttcaagaaagttgggctcattactgccatcttccgaggggatatctgtacactgattatatgtgaagactcagaatgctgggtctttttacgtttttaagctaatgggcaccgactgccacaggacagttcttccaatgaatggtttctctctacaagggtcagtacatgggacacagtgacggtcatctgaggatacctttcagagaggaagtgcgaaagctctgggatagttaactttagggttctcatcaggtagcttcaaagtgatcaatgtatagctacatgttctttatactacttttgattttcacaactctgttggtgcctgcagatacctaaggcacacagggtttaagtggcttgctcaagaccacagggctagtaaattatggcattgatactcaaactctgcaggttacagaattctatacattttcctttcatttcccaactttgaagggctttcatcttttagaatcaaggaggtataattacaggtagaaaaaaccttatggacaacccaagctaaccctcccatttctcaaatgtgctcagctgaggtctagagaaggaaaaaagaaaaatccatcactccagtgtgcaacaaagccaagagttcagatcctgatctggatgctgtattcaaattacgctacaggaagtgtcgtcctactcagttttcaaaggccaggtaggaaacaaaacaagccaatctgagcctcacttaaaatgtttatagaaagtaaataggggtgggggtggaggtgtaagtactctttaaaaccttctacatttttcctatatcaaatattagttttacagcatttgactcttctttatcagtttcaaaacaccactctaatgtcccaaatttccacagtgcttaccaactaattatgtgttctgaggaggaggcataacttaatacatagtccacaaccaccctcaactgctacaatgctcaacactctccaaagacatcccagggttgtccctctgggactgggggtgggggtgagaattttttctttaacacccgtgaaaggtaagtttgaaaagtctcagccttatcacctaacctgtggcatcaagtcacgctaaagtatacatgcaaaagccaacaccttttagttttgtaaaagccaaaacacatctcatctggtctttcagaatggggaaatatatagcctcccacatccctgccctcagtctccactgaaaattctgttttgtaaagatgagaagaactgagcttatgcaaagtgtaaggaaacagaacagatcacaatgacaaaagatcttcgtgtgtgagtgtgtctctgtgtgcgtggtgcgtgtgtgtgtgtgcgtgccttgacccaccaccctctcattgcaccactgagcacaagccagggtcactgatagtttataataaatatgtgatgaccaaataaagacaatgaggttaccaaaattatggtcaacttagtccagaatgaaaactagtaagaggattggttggatgaccttgtctgcacataagtaaaaagatgtggggttttattttttgcagaggtgagtacagtcaaagatgccatgcctttatagtcaagaataaggatcacaactaccagcaataaagacaaacacatattagcaccaccaatcataaagtaacaatacaattttatcaaattgctggaatgatcaacacagaatgcatttggcatatgctacctgtagaagagaaccgcatactgaggtctccaaccaaagtgctagaagacccagaatgcagaggcaccttatcaattcactcaaaagttacatcatctatgcccattaattgcatccatgtagggacaggtcatgctttgctaccacccactcaggacaccaagcatacggcccagagacagatgagttttcagaattttcaaacagggtagaaaccaaatctgcccctgaagtgaattaccgtcaggccttttttaacaatggggatatgttctgaaaatgtgtcactaggtgatctcgttgttgtacgatcatagaatgcacttatacaaacctagatggtaatagcctaccacacacctagttatatggtatgggctatggctcccagtctacaaacctgtataacatgtcactgtactgaatactgtaggtaattctaacacaatgctaagtattgtgtatttaaccatatctaaacatagaaaaggtaatgcattgcacaatattaggatgactatgatatcactagacaataggaattttttgcagtctactatattatggtaccacggtcgtacatgtgattaactgaaacgttatgtgatgcatgactgtacatgcagtgagggagaaacatttcgttttccatcctccatctccctcacttccatctctggcatccccagacaggaggtttcgaattttttataacaggatctccgaggaccctccaaattatgatagggcatcttttttaccctatctgtgaagttttacatgataccatgatcttcactgattccttcacttctctctcattttagaaaaaaattggtcctttggaactaagccaagttatccactctaatctttcttctcctccatcaccaacgagtgtagggagaagcatggaacctagaaaacagtgcccaggcactgctgaagccccctgactgtatgcatctgagcccagaagtatttcctagctttctcggtgccatagattcatgtttcccatgggagctcagaaaaggcaacgggtgctctacatgggcaccattcactccaaatccagtagcagttggcaaactgtaacacaggcagttgtaagagaaaatagtgcagcagctcaaacacaaggactactacaacaagcccctagaaatatgtctgctgggtctgtccactgctcaaggacatctttttattttatttatttatttttgagacgaagtctcgctctgtcacccaggctggagtgcagtggcgtgatctcggctcactgcaaactctgcctcccgggttcacaccattctctggccccagcctctcgagtagctgggactacaggcacccaaccaccacgtccggctaattttttttgtatttttagtagagacggggtttcaccatttagccatgatggtctcgatctcctgacctcgtgatccacccgccttggcctcccaaagtgctgggattacaggagtgagccaccacgcccagccatcttttatttatggtcatttataaatggaagtcaatttttaaatggagagcaagctagctgcctccagaatatctcagggaggggtgtggatgataacgtagtacatatggaaggtaaatattaaagtatccattaaatatatatttaaaataaaatataaaataaatatgtatttaaaataaagtattttttacttatatttaatagatgcactgaacccagtaccttctcagtcctgtgtatcacctgcctccctgggggaagactgagcaatcatcgaaggggagaggcggcgagtggcactctctcctgctctttagcctgaacaaaatccattttacaaataacacagcaagcagatatggaggattagactggataacctgctttaattaaaatgacctccatttaaagaaaaagtaacttaaaaaaagattactacaaatgtaaatcagagtaaagaatggtaccagtaagggaaatacaagtaaataaggaaagggagagccgattatttctcctactcttagtacaagctacattataaggttagacacaagataatccaacatgcatcacatgaagtcagatgagatatctgaaattattttatggtcttgctttaaaagacatttattaagatattaggtacatggaaaatgaagccaaccagtatagtaattagcaagacatttaatacagattgtctcatctttatccttttttatgtttgattagagtttataatttaatgaatagcacacgcccatgtacatatgtaatttatgaaaaaggcacataggagagagatgtgtataaacatttttctatcaacaggaccaaagctccaattataacctgtcaaaattttgaacagaaccatgtatcagatcattcctattttaaagctaggtgttcataagtagaaaataaaaataaagtacctgcctaatttctaaaaaaattagctgatggactatgggaaggcctacatgtaagtaaggggaaatgtgaacccgattaaagtcagaaataaaaataggaagataagttattgatgggtaagaaaatatactcggaatcccacaaataatgattatcaaaatctctccaaagcgccaaccgagaactgcttggaaattatctacaacaagatcatcttcttactgccttactgccttattcaattagatggtatcatctgtcctctaagaaagaggaaaagtattcaaggggattgataccggtttcttccaaaaggaaattgtgataatgcaaccagtacgtcatgccttaaaggcaactcaagtgctcatttaaaaggctttttaaaaaatgcataaaggctcatagaagcaggcacacaggtcattacactagatcatattcaataaaattatagctgtttcacagaaaagaacatgaaaaaatttggcttaaagtttaattctgatatcatgtcccaagaatatacttaaggggcttgaattacaccatccatccaaataaataaggcttgtcctattttgaaaactgcagtcaattaaataagcgtattagaccagcagtgctcatattacaacaattctctgattattcatagattgactaagccataaacctcacaaacccacctttaaacttaacccttattacatggatttttaagctttttgaccataaaagatatggctcatactttatgattattaaaagtattcttgaccataatacatataacttatattgctcaatctctctcaactcccaaggtactatgagaacataaaaatacagtgagaaattttctacatgtctgctgaaaggtgacaaaaactcaaggcaagagcattaaaacacaaatatcagggacaaaatatatctgtgtgatgatttagactcgaactacagaaaacagcaaaataccaacaaaacaagcaagcccttaattcaagtttctttatcaggtgaaagaagaagggggagtggggcggaaatcaagataatgacaaccaggttcaatatactgtattaaagaaaagcatcaaacatcaggttaaacctgaaatctgatttcttccaacacacccaatctagatcaaacactatctctgagcacactaactcgttcatattttattatctggacagggatcatgggaggaatgagaaatggggtgaatgggacaacagttaaaaatctgaagagagaataacaatttctcccattttctgaaaccaagtttcccttacaactgacaatctcttattctcttcttccaaaatgtctttctataggagtgaaggaaaaagaattttcaagttaatgataacatatggtactaaaagataaaaacacagaatgggccagaaaaagataattaaatttgaccataagaacatcctgtaaagctttactcaaccaaaaataaaaagcacagagcctgcagggatggaggctaggtaaacctaagggctgacacccatcaacaacctagcacctgagtcacctacaagccttgccatttcaataatcaggcactctcccaaatcctgtcttctcaatcttcctaagaattcaatcttgattccaagaactttgttttacttaataactatcaaacaaaatcattgcttcaatctggaaaaaaaaagtagctaatatagctttccactaacagcaaacattttataacttcacaatgttaaaaatcaaccaatacattatgaagaactttgttctatctaaactcgagatcattttcaaggccccaaagagctctgaaattaactggacaagctgcctaggaaatacctgtaaaattccttcaggcttgttcatcctacgtttgcaatttaaaaaagtatatttatacatatattattcacttaagatgtcacagaggaaacctatgtgcagagctgaaaaagggctttctttgtgagacttctttctccacaaaggcaagcatcaggcagccccacgcatctcccacactagtctgatcaccactaccatgggaagtcaaaggtggcaaaggttttttttttttttttttttttttttttttttttttttttaataccaatgccttttcctcacagcagagcatgaagtacaaggctcaatgcttttgacagtaccacctcttctcccacggcaaaggccaacttaagttgaaatttaatgtggcattcataacaaatttccttctcatatctcaagcaacataatttagtatttttttaaaaggagctatttttaactgattttatctccactctcttcagcactgcaaatattccaatgaaaaaaataaatgcatagatttaagctagaaaacataactcctgatcttattaggttatatttgtgattatatttttggtaattaactattctgtcccatgaatgaaataaataaaattgatatgcacttggaaataatttttaaaaatcagtgtggggttagatagcattctgggtatagtgtaccatatggccaaaaaggatatttaaaaatgtcctggaaaataaaaactgcatgacttgcttatgaaaccaaaaactctctgctctgcttaacttcttaaagtcactgttcttctcacatgcagattagagattttttgaatgactcctggtttgttatcccaggatcagaataaaacttaaacagttagcatatgtacacctgtcagtgagatagagtgtcttctttgggctaaagccacggtcattctatgaactacagagaggtcagtaaattacaaccgacaggccaaatggagactgcctcccacctgttgctgtatgggctataagctaagaatggcttttacatttttaacaggttgtttaaaaacaaaaacaagacagatgcaacagtgaccataacccataaagttaaatatttactatctggtactgtacagagaaagtctgccaacctgtttgtaaacaattttgaaaaggaagagaggaactcatttgtagaaacttcacgtagtcacataggttatatacccttaatggtgcacatactataaagtgaagtaacagaaacagcttgacctaaaaattgacacatgagaataaaatcctttaagaaaaaaaaaaaaggaaatctgaagccctggaaacaattcagataaccccagaaagctacagattagaatttctcaaccacagcattattggtgctttggaccaggtaacttctggttgctggggctatgctgtacactgtaggagcttagcagcatccccgacctctagcattacatgctagtagcacccccacaggttgtgccaacatgaatacctctagacattgccaaatgttccctgggaggcaaaaatcacccttggttaagaatcactgctgtaggttactgtcctttggtccccaccttcaatattagcaaaagacactattcctcaagtagattctctctgtgcccatggagatgaaaaattaatagtaataaaaccaacaacactgacaaaagcaaaccagagatcctgtcaataaaagtactggacagtaaacctgagtattctctttcagtttagtagctgggcacaagaaccaaaccagacttacctaaaacgctgtgcctgctgagctagcggtcctggataccttctgtttggagactggtacagctgggaaaggatggcctgattggttttttggcttgggttattagcaaactttacagtgattggctccgtggcaccgggaggtttctggccatttaggcctttgatagcttcttctgcctcaattcgcttgtcaaatcgaataaaccctacaccccttgatatgcctatggtagatttgagtaaagatttggaaaagagggaacagaaggagaagggaaggagagaagaaaggacacattaatttttccttctcaagaacatgttttcacctacatataacatttcccacaaaatcacaccaggaggaaactttcccctttacttactagccattcagtttagaatcacaattttgcatttttagaaaaattcgtgtcacttacataatctgagtacccattatcacatgcattccaatcagctaagacaagaaaacacaagcatgtccatgttttctctctctcccacctccctcccgtacactcttttaatgtcaatagtgtaccggagttccatttttcaatttgtgctattggataagcagctcagaaatgagggacacagtagttcctgtccttgaaacaaggagaacagaaagaagaatttgctaaaaatgctacaaagctatgctaaaaatacatacactgtggtagaaagacatttcggttgaaattttaaataatatattcagcttaataatattgcataggatataggtcctttaggaaaaaaatgcctgaaaatgctcttccagttctctgaagctctcttgtgcttctgactagctatattttattacagaaaaatattatatggagaaaaagaaaagacgtagattttaaaaataaataaatttctagaagtaaagcatcaaagctttctgacctcagcagcatcactcctgactacagaagatcactccctgccccacattctccccagtgtgaaagacacaaatgggaaaggatagccaagaacctttccaggttatgaaaaattgtagagggaaacccagcttattccatttaattagcgtgaacaggctagtggggtgaccacagctggtcatcatgagataagcagtggcagggaaattttttttggcaagtaaatgagcactggaccatcatacttggaggagcttaaaaaaaaaaaaagaaagaaggtctacttgctttaaaattaatactgtgtaaggtcaatgactaagaattttctaatgtagacaaagcattttttccacatatgcgtatctaagacagcccctatcactttaccttttctatttaaagagcatgcattgcacattattaccacctgatggctgaataagaaaattgcagggtttcatttttcatttcaggtaaattgagtaagttcactttgaaagccttaagtatgaagaataaatagtgaaatgatagcaaatcctttcacttatctactagcgcctattaagaattaataacctctagaatttagctgttccattagaaaagcatcagattagcaaaaaaaaaaaaaaaaaaaaaaaaaaaaaacagcctctacacagctagagtcacctaaatcggtggtcctcctacttaagcatacctaagaacaacctgtggctcaccctcagagatttattcagtaggttctgaatgaagcccaataatttgcatttttagcagggttccagaagactgctgatactgcaggtgcgggacatacttgagaaccgctgactaaaacaagctaggtccacctgtgatggactagcaggtaaaagatgagacgcactttgtgtcataggtgaaacctactctcaattcacaagatctcagaatgaatgaattagaaagcacaaatgaaataaaaaatatttttgttgctttgaacaaattcatctttatttctaggcctggatttctatttaacaccattattagtctatgtgataacaacacagggtggcaatgtataagtattatgaattaactaacacaattaaggaggctgtattttatatactctcacttgactaaatagtctcatgacagcaaaatctgtaggctattctcccaggcatgcatgtagtgctagctctctctactcagaactctaaaggtggtgcttcctatgaagccaattaacaacacagaggcaggtaatatgggctcctctgattagattcagatcaactaaatggatcttcacttgatgaatgaaaaatctggctcaattttcttctgaagtcactgctttaaaagaattagacattgtaatatacaacatgcctccaaggtattattattatacgggtggcggggagagaaacaaacagtgaggagaaaagctaccttaaaaaaacaaacaaaaacaacctcacaaatcttcatgtggctgcttcagtctatggtactacagctaatatttcctcctcacaatgtttctctattttttaactgtttcctaaagaacaagtattgctttcattttattttttacttattttttgaaatggagttttgctcttgttgcccattgcccaggctggagtgcaatggcatgatctcagctcaccgtgacctccgcctctggggttcaagtgattctcctgcctcagcctcctgagtacctgggattacaggcatgcgccatcacacccagctaattttgtatttttagtagagatggggcttctctatgttggtcacgctggtcttgaactcccagcctcaggtgatccgccctccttggcctcccaaagtgcttggattataggcatgagccactgtgcctggccaagtattgcttttataatagaaaattgtatctgtattttatttttaaaattcataatcaaatctatattgctatagctttgttaactaagatttggcagaacaactcccttacattcaagagttttaatgaacattttagtcttcccatttcagttgggctaacagtgatattaggaataaaataaatttttaacattcaaaatttcaaactcttacatatgcccatacagcacagcatgaacctggaaaacagcctgaacagcaattaccagtgtggatgtagtgtaatcctcccttggagaactagctgcataccgctgcattaaacttcgctttttgacaaaagaaaggttgtttattagtactctataagcaggatgggggcttttatcacacagtggcttggaaatgaagattatagcatctataaatttattacaagccatgaaacaggcttcaatcctgcaccttcagggtggaaatgactcaagcacgctcactatactccacaatctatttttatccatgcatatttatgaacaattccagcagaaaattgcattttctggcccacatatacctttgatatgttctagaagcaagactgctacatggaaagacagaatatttcacaatctgctagtcagagacagggaaagactgtccggagtggctgtctacttaccagtgacctggtcgacaagaatacgagaagtaataatgcgtccatattgtgaaaaaagctgttccaactccttctgggtcattgtttttggaagtccgctgacatataaatttgcatctctgatagaagctgaacttgggcgagcataggaaacctggaaaaggaaaataaaattaaatgtatatgcatgctcactcacccacctccctttagaaactcaaaaactgcctcggtaactttcccatgaacagcatagaacactgaagttcaagcaagtcaggtgctaactgctttattcatttccaggaaaattctagacaaatgggtagtagtattcccattccctctcccctaggtggacagggaagagtatctgtaatatgctggactagcctactgcaagggacagaaatttcacaatatatcccatcctccagattattactaaaaatggtcaatgggtctgggatcaatttgcggaggtatagtgattcaacaactgcctgctcattttatcatttgtacccacctttagtccagttttaattcactaaaatttaaagttcttaaaacagaccagtggtgcatacagcacagtactgttcacaataataggctgtcttctgtggggccaatcccctagagcagtggtccccaacctttttggtaccagggactggttttgtggaagacaatttttccatggaccatggtgggggatgcattagattctcataaaaactgcacaatctagattccttgcatgtgcagttcaaaatagggtttgtgccctgatgagaatctaatgctgcagctaatcggacaggaggtggagcttgggcaataatgctggctcacctgctgctcacctctggctgtgtgcactggttcctaacaggccacggactggtatgggtccatggccaggggttgggaacacctgctctagaatagggatttaggcccaatcattctaagcttaaagattccaaattcatggaacatttttgttttctagcctctcacatctgtgtgggtggtagtgctacatttctaaaaaaaaattcacccttatcagtaagtatgctcttttgatatatgctgtatgattgtccataaattcccagaaatttgaatgtgtgaacaagccctcattatcctttgtctgttgtcttctcatccacaggtctttttaaccttgattttcaaaaggtcttaagtccctataattaactttgcctgccactgtatgtactttcaaaaagtttcatgtctttgagatacggtataccaaatcccacaaggacgaaagacaaaataggtctgcatgtatttgtttataatcatcattcctcatgtaaactctgtgagggaagaaaccacatcattcttggtcatcactgtatcctcaatgcctagtgagtgcctgacatgtgatagatgctaacacatttggtgagtaaagcccatccaataataccccattgatcatgcagatccacaacggcttactgaaccagagcatttaagggtcagttcaagtcatccagatctcctgccccaattgtaattgatgactctctgcctataacctatctttgccaacatttagtctcatgagctattcctgatcgcattccctttggtttagctgtaatattctggactagcctacttcaagggacagaaatttcacaatatacgccatcctcagattattactaaaaatggtcaatgtgtctgggattgatttgctgaggtaaagtgataactactgcctgctcattttattattggtacccacctttaatccagttaacaacaaactttcccaatttacactaatacttaaataacttttagtatgaagcaccaaacattttccccataatttgaattgtgcccacagctctctgttgccactttttcttggctttccagaaaaaaatataagccacattttatactactttataaagacctcgttatctttcacacccctgccccaatggtgttaacatttaatactcttctttattcaaaccgtttgctcattaacaagtgaaaatatacctgttgttccaaaggctatgtttggaagttatattagcactgtcctgttctacagaagaaacaaggaatttggaatagtggtggagaaaacatacataactattcatacgctatttgttttctctatgcctaaatacttaagaacaatgaagactggggaacttaaatgtaagtgaagaacaagtggccaatttcaagtgattaatgtaacttagatggaatcaaatcttgggattgctataaactgatgaaacaaggccaatgaattatatatgcattcagtaatatgaatcaatgaaaacttaatttcttttctcgtgtaagattctcaattatccagaaaaggtgaaacctcaccagctgggacgtgcatccctatctaggattctatggcttttttttccacaggagggagcacccaacaagtcagctgttactctgttccagatcatgtgactgaagtactcccattatgaacagccatgtcccatgggctccagggcaggcatctacacattctccaaggaggctaacttccaatgactgatcaagcaaccagcagcaggtgacaggctctgcatgagatcaagtgtcacaggaggcagtggaaatgtggttaaaggtaacagctaatcggtgtgcctgggctcaaaactaggtttaattcataaccagttctgtgaacttagaactaagttcttcaagcctattaccacaattctaccttctttatatggctattaggaataattaaataatttctaatccacatgaaaagcttcagagcctaatctatgtgacattataaatattatttacctctacatgcatctgaaaatttaggtaaatgcccagccccttaaagtagagagaaacctgggtccattacagtgttctagaacaatttactcatgcagtgacattcactgctttgtgcaattcagatgagtgtaggtggtgtgtcttaaaagtcatcctaaaatatatttaggaaaatgggtttatatttaatgcttatataaaggctttgaaaacatacctaggtcagttatgtgattttttttttccccaatgtccactcttcagtttatattgtatctttagttcccagccacattaaaaaggctccaagacaaaccttctcaaaaacagtatctttcagtgacattgtcaaagaaccattttccactaccacaggcaggacaggagtgattagattatatataaacttacgtcggtaacaatgtttaatgttaaacttacatttagggcattatgagacttcaccatttacaaggcattttcacaaactacaatattttgtctgtgcctcacaacaaccccatgaggtaggcagcatacatattagtattttatagctggggaaacaggcacagacaaggtaaataacatgcctaaggttatacacaactagtgttgaattctgggttcaaactctgatctttctctttctgtgtcctggtctcctcatccagttttccttcaataatactatggtaagtgagtgtttcagttcacttgttctgagttgggaaaaattaaatgaatcctggctgtttcttaaaggcatacacagagaaactggccacagacagaaaacaggatgttgctagaaattagttaaaagttattccactttttattattttgagacggagtctcactctgttgctcaggctggagtgcagtgggtgatctcggctcactgtaacctctgcctcccgggttcaagctattctcctgcctcagccttccaagtagctgggattacaggcatgtaccaccacactggctttttttgtattttttagagacagggtttcaccatgttggtcagcctggtctcgaatgcctgacctcaggtgatcagcccacctcggcctcccaaagtgctgggattacaggcatgagccaccacgcccggctccattaatatttttaagagtaattttttctaagaaaagagaagtggccactaattacaattaaccaaagaaactacacatcatcattagaatttttaaattaatttttgttactttctaattctcaggagtaagcaatgccattttcgttcactttcaggaaataaaggtgtaagaaagggtaattgccttctccttcctcccagaccaaggctcaaggtcctacccctatccctttatttactgttcttggaattaaaacagcttcctttcccttccactatcaaggatatcgctgtcatcaaaatcctcccttcctggaaaacatttcttctttcatctaaaaagattataaatagaaaatgtatttagacctaagtgggaagaaggctgatagtgggataaggactcacactctggagatcagttacctaaggactcacactctggagatcaaatcagttaccaaactaaattttgtatctgaccattaccagcaaccttctccattccgattttttttttttcctgtggatttagatcttacaggtgccttcatatgcacctacagaatcatacaggggctattttcagaaagtgttaagtatctttttggttctacaagactaaactcccttgaaggcccaaaagagttcgctttaaatgacaaattctatttagaaatgcttcaaaacaatggacttccagcatatgtcctactgaggtcaaaatagcctctttctccactgcaatctgttctccattttccatttgctggattaatatatgagtttggattttaaattttcactgccacttaaacaggtgaatatttaatgcatgagaagcaaggttatgaaatgtcaaaactactaagtgaaggatctaatttaagaggcagccagagagtctgcaatttaaatatttaaagatgatacagggagtacaacactgaacaccaatctactccaaagatagcaatttaaaactcaggtttattctggaatttctcacaaaagctacgagtgatataataaacaaagacaagcaatactgagattatatgagggaaggggagggacggggaggcagtaagtacttgctactacaggtaagtaaatggcccatggcttctcaaactgttcttcacaaacaagactagactagacaaaataaagatagaatatatttattgaattatgtcttgaaaatggaaccgtttgaaatatagtgtattacttgtaattaaaagctcatttcttcatcagcagctaaaactaatgatacattaaacatacaaagatgagtaacacatacactaagagtgggctatcaaacacaagttgatcaaaattatacaaagaaacaaaaccatcttatgaattagtactttattaaatgtacatagcaatgtttaaaatcccagtgcatcactatcagaagtccctctaaatgctttcgtccaaacacacaactgctctcgtttctctgattcatcaatggaaagatcagtgacagtggacattaataccaatagattaaagtgataaggtctataaatgaacaaagaagttccctcttttttaaactaaaaacatttgagaagtcacccactgctaagatcaccactgaacaacttttatcacttgtcaattactgacccaggactacaaacattaaacctgaaaattagacacttgccactttagacttttttcaaaaagctcctttcaatctctccagctgaaaggtcacagttatgcctatttaaacggacagttaattgctgttcatattttttaaagatggagtcttcgtgggactatctgaaaaatgacactataactcaataaaagttagctctaggctctaagtaagcagtagcaaaggtcttgtgacagcatcatggatatttggacaggtggctacatcggaccttccaaaatgagctcagaagtatagtacacagaagaagggggatctctaaccacaactcaggccagagacctcaaaattcacccaaaaggaagatgtgtactttgatctgcttctaaattcaaactcctaccaggaacaagtctcaaacacacatcaaggcatacatgtatcacagtccaatattaagttttcaataaggaagggcatatttcacaatgggttgaaaatgaataagcctaagataacaataagaaattaagtattagctccagcaaagttagagctaaaagaaataatcacatccaaacaggaaattttataaaaggtattaaaggttagggcagttatctttaacggatattccaaaatataggatttagaaaactatcagtggaaaatacacacagaaccttaaattttatcgtgactggatttgttgaatgttttaagactaaacaattgctttaattcaagtgagaagttcagagataccacggaatatatttgataatgtcatcctcaacttaaattacctaaagggctccctaagactttcagataaattttagaattcttattcctttatggtcagagcactggctacctcttccatacaagtatacaaaaccttcggtagtattccaagcttcctgctctcacttctctgtgttaaaaataagctgccctccttccaatcagctaaatttcagtcatttcagacacctcatgggtatcacctagtccctaaagtcaacactaatcagtcctctccactacagtctgagttgggtgcctcttacctgcacccacactgcattatatgccttgttttcttaaatactgacttaaccaaaatgtacttatctcttaaccctttcttgtgactgacttaaccccttgaaataagaaaccttgtcatcatcctactttgtacatcctggtaactaccacacactcactgtaatgaagatgatttataatcacatattaaattgagagtttatttctgaaatactgtttaaaagctaacagaagccacaatctttgtcatatacccaacattatacgcattggtactttgtgtacagactacaatgaaaattctattaatcatttcaaaaatgaaatttcatttctcaaattggggattcaagtccccagaggcgacacaatcttcaacaaagtaatatggtgctgataggaggctgtggggcggggggagtcttaattttggagcaaaaagaaaatacagtgatcatttagtccaatttctttgtatctgggaaataggaagactgaggcacagaaaggtgaagcaacttttccaaagacacaaagaaaaagagttgggtgtaggactcgcggtcttagctcttcatcacgggattttccattacatcattagctgcaacacagtcttcaaaatcataaaatcttcctgtgaaatgacagtgactgggacaataatcagacatttccaaggagacatcagaagagctattcctagaaaataagaaccttagctttgctacatagaatattttcttgtatacacataaggaaataataaaacacatcaaaaaaactgtcttaggacagttattataattcttctactagtaatgcctgagaattatttaggagatgttggagaaaaaaatctaattatttgggagttgaagagaaaaatcaaactaagaatcctgagactagtactttccaccaattaaaacgtaccaacctacaatagctagaatctttttgatagtgtctctcccttttataagattacaaaccaattaacaggaaaacagaatggcaactggctgtttacactaggggagattctcattttcatagaattttcaagttttagtgcaacatcattaaatattagtcaaggcagttgatcttagcttcaacttaaaggcgacctaggaataaataagtaatgtcataaaaataagtgatcctatgacattgttaaagacaataataaatctactgaatagccacagaaaaataaaaagtgttttggctgtaagaactgtatatcaagcaactgatcatcaactacagacttcacaaattagaccacctttttcacacatcttaaacagcctctgacaaactacactgcactgagtgtggtttattaaatgctacccaaacagttgcatccatgtgtatcaaagagggtctaaataggctgccctgacaggcatctcgtttttagtaaagtacaactggtacataacttctgcccttttattgttgtttctccttggttctagtatgaagttggttcaacaaggacatctcatactggtaaaggcaaatgggatacatggtaaagatattcttgaaatgcaacttaggccataaataccttaccatttcttaaattttttacctgcagagatacttaacagaaaataaaacaattgagcaatggtagtggatatggcatctgaggtggaggcagtgaaatcaaattcactatggtagtggcagtaggctagccattccaagtctaagcaggaacttgtcaatcaaaatgttccatgttccatttccaatcctgtatatttcacttagccttttcagactttagaaggtgattacactaaagtagtataaaaaatagatgggagttttagcgtaaccaccaaagagtctattcctaccggtagctctctgcattagaaaattgtcagtagtggttaagaatgctaactcccttacttttaacttcagaaatgagcctgcatttatttagccacataatatttataaatactaagtaatgtgaataggctgcaactgaggcaagcacgtgttagcttagcaccaggttcaaaaatatattatacaaagcagaagagaatacactgtaactggtaaagttctggccactacacagcatactatgaaactagaggttaggatggaatgtttggaccagaaccctcccatgttaaggagtaaaaacatatggtatggagtcacacagagctaggtccaggtcttggctctgttacttaccagttaatcatttccttaggtcttctatctctttatttgtaatttgatgttaatcacagtacttacctcatggaaaccttacaagtattaaatgcaacaataaaactattagcaaagagcagaggaaccataaatgttttaatcataacatcattttatatacatacataggaaacaattcagataatgatagctcctaacacttattgtttaccatgtgccagacactgttctggatatgtaacatatgttaattcaattgctcctcccaataagtttatgcagcatcatcatccccaatttatggaacaaaaactcaaggaatactattatctttgaggtcaggaaagatgacacagaggaggagacgtggcacaagaacaatgtatgcactctaacacagaaacagttcaaaaatcacatatataaatgaggcttcttccaaatccatggtgataattattaaagttaattcctgaatattccaaatattttgtaagatgacagcagatgagtgtgctgggaagcctgcagcctggatggagggaacataaggaaggagctgtcttactgacatacagagagcaaacattcaacatctataaatgggccaacagttaaggccccaaaattttatttctcccatcaagctgttacatattaaacctctcactacctcaattctcttttgtagagacctgttgaacctaagccagtaaaacgtaaaatgagcgattcttttggatagacagtagtagaaatataaatgaacttcatggaataacttctatcttgagatgaaggttatgggtatgtttctgcatgtgaaatgtgttacaagctaccatgcaatcggccacctgatgattcaatatgatttcccagttaaaaaaaaaatactgaagaggctacactctcaagtaccactataaaactttcactttagacattttcattaaatatactatgaatacattcgagagactaaaagaaaaatctcagtactcactagtcagtactcagtattttgagccttcttaaatacggccagagaactagactgcctcaaagcttcctcccaagttaacagtattaccattcaaagcttttatattactatgttttatacttctagagggagggttgaaactaagtcttatatgatgcctatctcacatagtcccacccaccaagtagggactctactacctgttgaacgtatacattccatggccttgtgcaggaggtttttcttttttgaggcagagtctcactctggagtgcagtggcacgatctcagctcactgcaagctccacctcccgggttcacaccattctcctgcctcagcctcccgagtagctgggaacacaggcgcccgccaccacgcccggctaattttgttgtatttttgtagagacggggtttcacagtgttagccagaatggtcttgatctcctgacctcgtgagccgcccgtctcggcctcccaaagcgctgggattacaggcgtgagccaccacgcccagctaggaggttgttctgaagtacctctcaagcaagatgattagaagttgtggcatttgcccaaataacttggcttttgctgcttcactgaaaacaacgcaggctaaattggcttgcagaaaatcagatatattcattcaattgttagaagcccattctccagcaatggcttcagtattctttcaagattctgaaacttgacccaatgacatctcgaacagatgccaatactatcaagataaccatggcaactttatctccaaaaatgtacttaagatataatttgtgtagtatctgaatgtctagtatgcctaagacactgtcaacagattaaaatgctgagttagaatgttaaactaaagaaggactacacactggctggcataaataaactgcaggtgtcttagaataaaaaacaaccagtaccggttggtaatgtgaaaaaagaaaaaaggttctcatcaagccaattttggtgaattaaacatcctaggactttcatacacttcttcatccatgatctgacagagagaagtacatgaaaaggagaagtggataagacaagagacgggtaggtggacattatgtagaaaatctcacataacgggatacctttacttaaatctttgtttttcaccacatgttctcactcataggtgggaagtgaacaatgagaacacttggacacagggtggggaacatcacacaccggggcctgttgtcgggttgggggaggggggagggatagcattaggagatatacctaatgtaaatgatgagttaatgggtgcagcacaccaacatggcacatgtatacatatataacaaacctgcacgttgtgcacatgtaccctagaacttaaagtataattttaaaaatatgtatatataaaaaaactttgtttttgtatgaaacaaaaaagctgttaagtcctttacatatccttcatccgaccacatcttcaatgtatagtgacacctaccaacaagttttgaaaaacacacccaaagttaaaaatggcattaaaacaaaaacaaaacaaaacgaaaaacctccaagaatctcaacttttaatttcacttaaactgtgacttttttcgtctttgagcacacagagcaggtcttcactgtctcttataagcaatagacagaagcttcctcatgcagaggttataaataaaaacattctgcaagctgctctccaaagacaaaaatcccgttgccctcagagagcagaccaccaaatagatgagaaaggaaatgtatagttaagaaatttttatccactttattaatttattttatggccaaataaaactttatcaatgacagggttagagggccatgtaggcagagaataatccaaggcaatggagaattaggcttccatactgaatgatgaagagcccagctgagccagaataaagatttctgtaggacactgacaacactagaacagtgagttgagggcagagtctagagaccttgaatgtcagggcaaaacttttatgagcagaggaatgacaatctaaatgttggtaagtattatcagacagaaatgtatggaaggagaatacagagacagtttcccatcataacgcaggtgaggagaacagtcaaaatcagtgtggtagtaaagttaaatgtaaatgccatctacagttaagtttccctttgtactataactagaagaaaaactgctttgcaacaatgttcagaaacccaagtcttctttgacctacttcatatagtaatgaaaatataatgatcctttcctctgtgtgtacactaaatactgcttagagaaacttcatcttgataccatttgtaaatacttaaatgagtcccatgggtctccacggatctttgcagagcaaggcaaatatgtttctacgagcaaattacttgatccacccaaaattcattcctattgtttctcttataaattaggtcctcactaaagggggataaatgtaaagtacagggctaggtttaatcaaattttcctgccaatcatttttgtagaaggttattacttgatagaataagtatactttatggtgttcagatgtaagcttctcctaaaaggtacacatcacgtgaaggcctctgtgcttttgaatgagacattcccttatgtgtaatacatttcttctttttccgcccaataaaacctagcttgtaaaacaccatcaactctgaaatcaacacagaggcctctagacagcaagtggcatatccattttcattgtattctgcacttactcatcatatatccaaataatggtcatataaactaagtgctgtctcccttactacacaatgacatcaaggacaaggctacctcttgtcttattttaatgctgttcaaacatttagcaaagctaactagcccacattaagcactcaaaatgtttataaaatatttaattacagatactccctgtccaacactgtatagccaagattacatggtctcagtaaaacaaaaaaacaacttgcaattaaatacttctcaaaaacttttacatttgcttatcctggccctttgttttgtgggcaaggtgagcaccatgcacatcttttaaagctactgacctttcctacaaacttggagacaggcctattagtcttgttatggttccatataatataataaagccctaaggggtgggaagtcttgaacataaagtaactacttctactaaatctttaacgtattttaaaaataggattcctcaaacacccagagaaaaattcctaacaaataatcttcctcttaaaggatgttttatgtcaacaatccccatttaaacacctgttttaaatttaaaacacaatctgcaagccctatctacattacaagtaaaccatacgctatccaagatttagtgttttgggccctgatttgacacaattatcagggatctaatgtatgtatacaggtatacatacacaaagaagttaggaagccagctcactttctttcaagggcagcctgtctttggtaatcctcaatcagtagaaactgtaccagttttttaaaaatttaaaaagcagtaacagcaaacactgcagattgcttatggcatttaacaggcagagatggaaatttgtgtaaggcacgtatgataaaggagaaagcaaggaaaaagaataacagaaatgttattaaaagccctccccacagagccaaaggaagttttacctacacatattttgtggggctgacataagttatgcaactatgaaaaatttattcaatacataaggggataacccctgaaacattagtgagtgttgttttatgactttaagtctaccaagatatttctctcacaacatgattagacattagagaataaccatagggaaagctttttttaaatgaactgatttgcaagactaatagtctcattcaaagacaatccttcattctccaagtatctattagacacctgagctgtatattccccctaacagctttaacaaaaaataattactgtattcccaaaaccctttgtgtgacagttgtgaagattttaaaagaaagagtttttaaggaaaacatggacaaccttcactgtacgcaataaagagaccatatcattgccatctatgcaacacctgcagaaatttaaagaggggcagcgaggaggggaactaccacctttatctttgttctaagacaaagtgttctcctgcttcagatctccagaagcaccttgagaatcccgtcctgagatatttaattacactgaatgatttggtaccaggccctttccctgggtcttgctgactgatagcatcaataacactcactggctgtaattaaaccgccaaatagtatcccctttgccacttggcagataaatgttctttaatactccaaagaacaaagtacaaaggtgagaggggtgtttttacccctcaccttcacagttcatctgactttgtgcaccaggatatacatatactgtagacaatgcatattttacaattcccctcagacattgcttaatgaagaacatgaagaaaaatccttggtttcttattaattcatttttgcaactctgagcagggggaaaacactgtaagccttttggcaagagtatgcactgctttcacatagctttggggcaacatttggtttacaggtcaaaagggtttctaaattaagtttgcatatagcaaaaaattttttcctttaaaaaattatagcataaaatgtgtggaagctcttataatagagcaaattcccatttattgaggccctggctagaaagctcaaatatcaagacactgggtagggaaggaagaggggtttggttggcaggctataaaaataagacaaatttttattaaattttaaaagccacttttttttttttttttttgagatgggagttttgctcttgttgctcaggttggagtataatggtgtgatctcagcttactgcaacttccgcctcccgggttcaagggattctcctgcctcagcctccccagtagctgggtttacaggcacctgctaccaaacccagctaattttttgtattttaagtagagacgtggtttcactacattgtccacgctgatctcaaactccggacctcaggtgatccacccgcctcagcctcccaaagtgctgggattacaggcgtgagccaccgcgcctggctcaaaagccactttcaaaacttaactcccaatctctataagacaccctttcaccttttttttttgagacagaatctccctctatccacccaggctagggtgcagtggtgtaatctcggctcacagcaacctccgcctcccaagttcaagtaattctccctgcctcagcctccggagtagctgggatcacaggcacccgccaccatgttcggctaatttttgtactttttagtagagatggggtttcgtcatgttggcggccaagctgatcctgaacttctgactgcccacctcagcctcccaaagtgctgggattacaggtatgaaccactgtgcctggccaagacacccattttaaatggataggccctaaagaaccatactgaaaattctccaaataccctcagaagcaaataaattatgctagcataattgtaatgttgaagtatttaatgacacacaaatgccctgaaaatgagcaaattgtgtgtgagaacgtgcattatttcttaggtaaatccagcactatattcattaaaaacacattagtgaatcccagccattcaacatatcttgatgtaaccgacaaatgaaaatcctattttttacaagtagacttgttttaaaataagcaccacagacctacccaagtgcaaatcattaagatccactgaacagtgtttctcaggtcaggccaccatctgcttaagaatcacctgtggtggctgttgaaatacaatttcctcagtctctctctgcagataatcagattcagtaagtcctggttggggtgtagaaatctgcatttttaatcaaccaccccaccccactgatcctgataaacattaaagtgttggcagtctcttgtgtaaaggcatttgaaataatcctcaaaactctgggcatattagggtttcctagatagctcataacaaccacggatgccaagcccttttccttgccatccactgatcgttagtttctaaataagacaaatgccaggtagcttgaaagcaaagcatttaggaatataaatcacctgcaaatgcaaaaatgcagacgtaaaataaagcccatgaaactcatccaaagatatttccaagaacccagactggctggatgtggctcaactgggttagcctcttcaaaaaggccactgtgcttgattctatgaagttaggagcttctctcaatgactctttctaggaatatgaatatggttatttggttaaggcaagcacaaatttctagatagacatttaacaaccaaaactagaaactgaaactttttctgaattattagtttccaggactacatgcttgttctatttttccttgcccttcctgcagctcacctgatcaagaaaccaagaacagaacacaaatccaagacttacacctccaagtcctattgcagcattcaaaagagttcttcacagaaggaagggagaggaggcaggcaagtatcagatttcctgtactgttttcaaaatacagatgaccctggaacaatatgggtttgaactgtgtgggtgcacttaatatgggattttagaccaacccctccctcttcctctgcctactcaacataaacatgacaagggggaaggatccttatgatgatccacttccacttaatgaacagtaaatatattttgtctaccttatgattctcttaaccttttcttttctctagcttactttatattgtaataacacataatatgtaatacatgaaacatacaaaatatgtgataactgtttatgttatcagtaaggcttctagtcaacagtaggctactagtagttaggtttttgaggagtcaaaagttagactttttgctatatgggggctgctacccatagcccccgaattgttcaagtgtcaactgtacagctctgtctcattgcccaaaagcagcatgtcaagacacttctggaaataaaacatccacaagtaattctaatgtagtacatgcgggtgagaacacacactaaaagtaatgataggaatggctggcagaagtgaaaataaaagaaaatgcaccatccatgcttttttaaagagtctacgcaaatttaaagagagaccaatgttaacacacatttctgtaacctttaaactagcatctacgacttacatgaacctaccagaaaaacattgtcgaagaatgcgtagctgcctaaaaaataatttcaggaagttactactataataataattttactgttcattacaactgaaataactgaatcaatgttaactcacttatctgctaagtatgacctccagatccagttttcttctcaaactgtacgtctggctgtctcaagtgctcactctgcaagagggcagagttcttcactcctaggcaaagacagctccactctctggcacctaagagatctggtccagaaagtctcaagacaaagacactcaaaggcccaaattaaggcctctctcagttggtttatttagagtggtatctgagcaaaacagtttaacatcaataatgtgaaatggaaagaaaacaacaaaagctacggcatcagccaacatgatactacatttctgatgcttattagctatttcattttgaacaaatcccttttaacctgagctttatttcatcaaagggattaagtatttgcctaccagagactactgctgtttctgcacgaattcaaaacagtaaaaagataatagtcctatgaaatttgtttcaaaagtagatacagcaaagaattaagggctccttcttgggaagttaacacaatcatcttaacttcacaagccaggtatgtggtagaacagactgaagccaaactgacctagcaccacttttcccaggtgataaatgaaagaaaagccctaccccacattccccttaaaaagcagtgggaaagtaaagcaacaagggctagcagtgtgatgttcaggtagaaaagatttttgttttcttcttgtaaatttgtttgagttcattgtagattctggtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaactgaacaatgagaacacacggacacaggaaggggaacaacacaccctggggactgttgtggggacgggggagggatagcattaggagatatacctaatgctgaatgaccagttaatgggtgcagcacaccagcatggcacatgtatacatatgtaactgacctgcacattgtgcacatgtaccctaaaacttaaagcataataataatttaaaaaaaaaaaagaaaagatttttggccatccagatcagtttcaatttatcttatctcactgttatcttagaaatcaaactcaaacacatttgaacatgtggttcaactattttcagtgtcttctatcatgatgcacatggtttgcttgaatctcttcctcagcctccttattattcggaaaccaattttgcacttaacattctagacctgtgagctgttataagggttctgcctcaatgactcaaatttctgataaacagtaagtttcagtgacatccccaccacatgcccctttcaattccacacgtgcacacacacacagacagcaacaatttcctaaacctatacaagttattacttctgtggctttccccctaccttacacagaagcaatactcacaaggaggcagttactcttttaattccaatggaggtcttcataaaacctgacattctccatgctggttacagaaatgaaatagccaggcttttctggtatagaccatactttgcataagtttaagcatctgccatgaggggctatgatacccctgtggagcatgcttaggtaacaaaatgatccatcaattccaataaagatgggttcagtcaactgttgagactcttctaccatcactatccactgtgtggctgacaggcaggaagtaagcaggggacactgccaccaagaaccctgttcctcatccttccctctttgtaggctctgcctctgctccaacaactgtgggaaaatctaaaggaaatccattggaagaatgcctagttattgccctttgagaattccaattaactctcactttggagttggctaaaaggaacagaagtaacacaagaggcctgaggacaggacattcaagctctggaccttacttgggctacctacccacattccctagaccacattagatgagtaagaaatttctgggctttttgtatgaaaaaaattaaagctgacaagagagcattctacaaaacacatgaagggcattatacaaataacaataaaaaagtcatctgtgacttctcacttcaaataaggactatgtaaatgggactcaatatagatagaagcattttatttaaatgtattgaagaggtgctgataatcagatgtaatatactgttaaaacttgacatgtggctgtggaaatttccagaatacaagttaacaatgaagttaggaaaacatgtactcggtcagtctgtattttttaaaaggcagaggaacaatttactcaacgtttcaatttttaccccactcctggcatatactttttcaattttttttttgtctggataaataacagttattaggctaacatctcataagtaggtcagttaatttgaggcctgttcttccaactattacttctaaattttccaaatctgctcaaggtaaaggtttttaaatgaggggtactttgtagacgatgatttataaatttctaccctttgtaccatcacaggaaataacaaactacacaagccagaaaaacactagggtgggttgaaatgctgagaaagatgtggcgtttaaatacaaaacaaaccttcctctccgaataaatactcaaggtcaatcccaacactactctgctcaaaaccctccggtgccccttcctcacctagagaacaaaacatcagcgccttcacatacatgcgcacccagaacacacttctataacgcataactcaggctcatttcccacactcgcctcccatcctgctttctttttgggcaaattctatatggttcccctatcaactgctttaaaacttccatgccctactaaagtcatgaactcccagcattatggctattagagccactcgtctcaaacacagaactgtgctgcaggtattttaacagaggacctactgggtggcaagcccttagcgtagctttacttacattcctgcctgcataccctctcctccttctttacagtgggggctggtttacacagcatctaagaatatttccttctggccagtattaacttttataaaagaacaaattataatgataaagaaaaaccaacccaatcccaataatcctgtcgcaaaaggaggttgaactagaaactcaaatccccatataaagtttacagtggctattaaactttcaagagtgaaagaagaaggcaattaaaattattctctcttcaggagaggttgctgcttttcatcaaatcattttatgcaataaacatgaatttgtttaaaaagttaacatttcttcttaatatgcaacttagcagaccatgaaaagctttttttcctctcctaaaaagcaggtaatgaaaattctcagtgatgaataaattattttaacgatataaatggaaacttaaatggttaaaagctctgtccaagattaagcagccagttaaatcattttagtaaggtaatttagacagagtaagatttcagaaatgtagttctatattcctatgttaagggtcaagctcatgctgaacagaaaaaaaaaagtataaatatgacatttactaatgaggaaaggataagctagttagaaaaaggtataaatttaacaaaaagttaatggcaatacagtagcttagaatacaggtttcttaggtttgcttaatcactctcaaactgaacacaaaaaatagataatactatttataatattctcatttttataatagaattttccaaatgtggttaaattgtggtttatttcagtataagaaatttcatgattgtataccaattaataacttttaagcaaaggtaaattttagcctggtctatagctgaatgattaaggaaaatatttctttaatcaagaccaaaatcgggcagtttttctatggtagttaattctagacagaatttttttttcttttgaggggtcagaacttaccaataacaataaaacattctattccctgagataacagctccttctttccagataaatcaaccccagtttcaggaaaaataaagcatcctaggcccattgtagaggagggaaaagctgagagagatgctgggagccacgtatccatttcactgtgttatgtgataatcacctatccagagttctttatgcagaggagggaggaagtctacacatattcttggaaatgaatgattttagtttgctaatcatgaatttaagtctgacaccgttaacctaacaagtcaaaagtattggctttaagccataaaaattccacatactatttagatttttttcaatacttaagacccctaaaaataaaatgagtagagaaagagcatgaagactgaacacagtaggtacaaccactcacttcatgaataactcaccaaaggaaggattcctttagggacctgaaggatcttggagaaaaacctctcttcttctcaccagcatacaacttgacacttccatgagattactcccccacccccatgcctgaactgtacacatatcaccttttcactaccttccctaatgagaatcttaaaacatttttgtaatattcacactttatttaccatgtcaacactggggatactgtgggcaggcttaacccaaaatagctgcctcccatgcagtacagggatgatgtcatttcaccagcaaggtatgcctctgggacatctccttaaccaggaaaaaaagtgacctttaggacaagagaacaagtatctcgagactttaacctgtatctgctactacttaaacaaacagcatcctactatgagacggatacgttgttttcaatttctatgccatgtttttttataagcaaaggctggtgaaccacgttgaactctgaatgctaaacgatcgcccagcatgctcaagaaaaaacattaatattttggttaacagaatgaaccacaggaggattattaaggtaaaatgctagaagacaaactgaactttgcacacacaaataccaaatgtatagagaaccgccaaacatctttggtgattcccaagtgctaggccttagacttgctgtcataaattacctgggaagcataataaaaaacagaacccggaatctcacctgtggacagggatcgagtagatctacagtggatcccagaaactgtatttctaactcacttcccttgggattaagatgcaaccaaagtttgggaacaaatgctttaggtcctcacagagcctgagggacttcacttcactcaccatggaaatactgaacatctgtcatttattcaacacaccaactactgcacaaaaccctactgagctaatgctattagggagccccaggagaaactgctaaataaaccacctttcacagcacttgattcactgtttcaatatcccaataaccaggaattttaccaaacgcatactaaattctaagtggcttggagtacacaaacacttgtatatactaaccaatcttctgtacctttctaaagtaaagcacagtgtcctggcaagagttttgatataacgatcagaagacaaggatttgtttgagtcgcagctctttcttcaactgcctggtcttggctaaattgtatgaccaccaagatctccactctgactgtggacagagaacagtgcttaagcctaaattacatatgggtccccctgtaattccaaaacttctgtggttcctcaagggtaaagaatatagacttcaaagaagggggaactcagcaggagctggaacaacctggaaagacagaagctgaaggacagaattcctttagatgggctccaaaagatgagatgaccacagttaaactaaaaatgagtgtgaaagggtataccaaaaagtcggagctgcaaaagcatatgcatggacgctgggagtaagatcagcttacaagtaaagagccagtctgagaacagtggagaacggcaatagcactggcatcactcctacaaaactcagccagatgatagggtaaaacagtagagaaacaccatagagttttgagtgagcagtaacacgagtaaagtggtgctgtgtaagaaagtggtgctgacagccatcaccagtatagattagacgagggaaaaagacttatttatggaatagtatcccaggaaatgaaaaggcttaactcaacttccaaaacattcttaaagctgtgaatactagaaaaacttggctcaagacattgtacaagagcacaaaatctgtctaatggaaataaataaacatagaaagaacaaacaggcaaagggggtgctatatacttgtgggaaatggtctgctttgcctcttagacaaatgtgggccaaattgaggatgccagctgttatctgatatttttacaggaaccaaataggggcggggaaagaagtagcctgctatttgcccattaccctgacccacatctcagaaaatcagaaactgatgtcacactataaaagccacaaagctttactgtgctttcttccacatattcagcccaagcagctgggccctaaagagaaaaggctggatgatgaacagtaaggaagcagctgtcatcaactgtctccttgaaggccacgggcatttctcctgtggagacctatttcccctgcatttctaccttcttctggatcttcgtgcaggaggatatttagtaaaagaactgacacactagaatgaaataagggtaattatttctagaatggagaaaaggatagttcctgggacaagccatcttgaccacctattccattttcttcccaactacaactcaggacctcagaactaggacaaattagcagcaacgctggaaatcaatataaattgaggaaaagaaacctgcaaaaatctgctgtaggataaagagcacacggtctgacggtaactgaacactggatgtctttttaaagaacacttattgttacttaatagtactagtaaaagatctctgacacagaaagtatgcagagaaatatagataacgagaaaaagcagttcagactgaaaaaacttcaaaacaaacttgtcttacactttattggaaatctcatttttcccttcacattttgataatatacagtaaccagttcattttctgattggtgaatcttttcatagaacagtttcttgctcaagaagtatctagaattcttggacctctcataccctagtatatttgggaaccactatatactttcatttagataagacagggctggtaggcatttttcttaggggccaataaatataaagactgatgtgtcaaaaccactcagggctaataaattaccttaactggtaattctaagaaaagcaactttaaagcacaaaaatgacacttcatttccagatacctgaaaaaaatgagcaaaaatcttttacacaagtctctaagcaagatggatactacagtcagccttgactaacttcccctcaccacttcaggctatagtctgagctggtttcttaaatcaagggtggaaaataggttcaaacttgagtcaattgatagaagttgtctggaacactattttgaaaaaaatatttgggagccacatctagactctgtgagaaagagtgccatgattgactggcaatgtctgcactgggcaggagagggcaaattgatggtacagctaactaagaatttgctagaggcgacatccctcttattttctaaaggaaaagaaatctatgctgtgaattagattagctccctctcaagagagaatctacataagaatttcaaagattcacaaaagcagcaaagtatgtacaaagttatttactgtacgtcttaaaaagaaaaacaacagaaaaaataacctgtgtcatgtaagttcctccagtcagtctcctcaaagcaagctgaattagctagagcaaactacaactcaagcaccacatctagcctgccacctttttgtataacccatgagctaagaatggtttttacattttttaacttggaaaaaataaaaagaatatttgtaatacataaacatcttatcaatctcaagtttcattgcccataaataaagttttattggataacggctgcatccatttgtttatgtagtggctattactgctttcatactataaaggcagagttgagaagttgtgacagaatgcatggctcgcaaaaccttgcttattcactacccagacctttatagaagaacaagtctaaggtttcctcaagttatagggcaagtaattctctataagggaaggagacttgattccgtaggcttcctataacatttatctaagagagttgttgctctgtccccctttgcgaatacatgaatgattatacatagcactcttgaacaaacagtttcttccatcttgcaacaaacaccaaaattccactatgtctcccaggtaactgtttatatgggcccaaaaggaagaaaggaaagaactacaaataaatcttaatttttttaaacttctgttccgcaagtagatataaaaaaactttaaacatacttttattgttttggtttgaagtctcaatccattcagggtgttgatagctttctctgcatccttggggtcaatgtagttcacaaagccatatcccaagctctgccctaatgaaaaggaaggggaaaaaggcatatattagttctatactgttgacagagatcaactttcattttggcatatggtcttgtcattaacaccagcatatttcctcaacagtaaaaagaactctctattaattctagaaatatacatgaagtctttatgtctcctgtctactacattttcaagttttagaactcagcaagcagtgctgtttaggaaaaaaaaaacacacatccccaaaggattccaccatccatgccctgcctgagccagagtataccatcagcaagacaaggtcagcttcataaactgtggggataaatctctgtgctatggagagggcttaacaggcaataccttttcagcttcagtttccttagccataaaaatgggaagacagaaaacatcaaccaagaatctgtcagtgttcagtaaattgtaccctgacatatttacagcctttaccaagtacaataatgtcggagtctaaaatggtgaagaaccatgtgtgggcgtgtatacatgtaagtttattttagacgagggcttatcttcaaatacactcaatcaaatttctccaaagagggttttatgatctagataagaacaggaaaatatgaacacaaaagacttacagggatgacatcgaagacaatgagaacatataggaaaagaagaaatagaacataaacaaaaataacaggagaaaaaaagtctagagtaaaagttgcttctaagtgtttgttgttgttgccaccctccccccatcatctgagccctctcactcctggttcactgatgccctagatctcagacaatgggagctatcaaaagcagttgcatcaatggaatgcaaagataactaaagtcaatcgcaatggtctcaacttttcaatgaagcaagtttctcagtttgaaatggcaagaaacattatacaggtgacaaaaatggcataagaaaagtttagtctacaaaagtcaaaacaaactaaatgacgatttcccagatgcccaaggacggtccaaatgcttttactaagtactactgttgcatcaatttcatagggaagtgaggtattttttcttgatggggcaccgtaggtgcaagtggttatcaatgtgggtttttaggacagctactctggttatcctaatgtggatacttgttaccacataaacgaaaagagaaggctaaatacagtgcccaatatgaaaactagtgattatattttgggaccacaatcagaattttggataatcactgctaatatatgtcctctatcaaaatgtattttttcctttttaaaaaagagaaaggaatagagagctaaaaactaattaggttaatttcatctcacactaaaattgaggttttattttacagttctagtaaagagtcacatgtgaagccactgtatttttaagcattcagcttttcattaattcaaaatttatcatgtgtttactgcatgcattgtgcccctcttatgaaaatgtgttgcagtcctattgtcattgagtagaattaaattggctgaatgtaacaaaatctgctcaaggaaccagcttatagtggaaagacagacttccaataccggctctggtgtttactggctcgcagttagctgtgcaactttgaagaagctacttaacacctctctgaaccacagcttccttctctctaaaacgagggtaattcctacccaactaggttgctgatgcaatgatgaaaatattcattaatgatgaaagtggatcgtcaccctagtcaaaagataacatgagaaaaaataacatgcttactgttaaagattttaagtatattcatttaaagttaaataaaaaagatgccacaaatataacagaaaaagaaaagggcaatacaaatatagttttgtcatactgctattctatgacaaaataaatcaattgtatcagcatagtctaattgccctttctactgatagatactcctcctcctgcatcttagcagcttctaaccccagtgcattctcaaacttgactgcaatggaatcatctagaaagcttaaaaaaaaaaaaaaaaaaaactaaaacaaaaaaacctgatccccgaatcccactcccaaaaatagatagatatatatacatatatgtgtgtttgtgtctgtatatatatgtgtatatgagatgagatctcactacattggctgggccatgcttgaactcctggactcaagcgatcctcccaccttgggctctgattttatcagtctgtcatgaagcattggtactagctttttaaaatcctggtgactaacgtacaaccaccatgttgagaaatcactgccttaatggtgagaacctagctggggctacaacggggctgctgggaggtctaagaaaggtcttgcagggatgactgctgtttcacagttgcgttgtttaggtacacgtggatgtgtttcttctaaaatcttcaagttacctattacttcaaagaaacagtttattggcctcctgaggtctgtctggggcacaagagtgcctactgagattagatcactgggtaaagtgaaaagcctgtcttgcttacttcctacttagctgtttcccactctagcctctgaacccttactcctggcctgctgtaggcatggaaacatttgctaaatgaaagaatgagaaacttactgatgttatttatttaaccaaaggtattatcatcatcaccaccaccaccatcagaagacccaaccatcaaatgggtcttccacctgataccctcaagcaatcatgactagctatatgagtcagtcaaatatctagtatctgttaagttgtttatactcagaaatatttatccccaaatgactttgcctccttataaaaagtttcttatttgcctagtggcattattaggatgagtgccactcagaatatgtttgaggtaagcaaaactgtattattatcctaagcaaaataatatgaaagggggtatctgctattaaaagactgcattcctaaacctaccatcgttggtgtattaaaatgttggcactataacaaaagggagttagaactttaaattactttacagtgaaaatctgtaatcaaggcagcaaatatttattggatgtttaaaatatattaagggtatcgcagatgataccaagataggcaagcctccccattctcaccttttagctacatggtattttactgtttaattgtagcttcacattaaccatgttcggtattcagattcttctcctacaaggtagaaatgatatctgaagcttggcaaggtcaatcagcttctacaaatcaaaaaggcagggaggaagtagtaaagtcaggacttgaagtcaggactttcaaatgctgtgctctactccactcaattaactagtttatacctgaactgagacttcaggcatattgcgtataagcccaggactagtttgtacccaatatgcctgaataataacgtaaccaggcacttctgacacttttaccgcaaaagttgtttcttgtttgattactatctcaaacttctgtaccttttatacaaatatcagttttactatatatgaatttcagtgccattattcattcctatgacaacataaattgcatcttatttatatagtgcatatttctggttataaatgagcgcacagtttttaaaaataaaagcagtagcaaggcaaacattacaaaaaaaaataccttacctacccttttcccactcttatattcatcagtaagtcatgggccaccagggaaggcttggaaaccaagcatcacttatccatatcatccaaacctatttttcaagtctctctgaatttagaatgtgcatactgataatccccaaactaagattcatttctttaaaaagttttataagatgctacatttaaattccaagtacaaccattatggaaaccaacatgattaaaagactattctgaccaaaatgacaaagctaaggctcttcaaaaaaaaaaaaaaaaaaaaaagcccttaagaaaaacaaatcctgtctttaaatgccaaaaaatttgcctggtaactgaacataaagaagaggctcaatgccacgtgtcctcagctattctcagaagctacctgtggtcaagtgttctaagaattttcaaaccattaattcaaatctttcttcttttgaggcaaggtctctctctctgtcatccagactggatggcagtgggcatgatctcggatcactgcaacttccacctcctgggttcaagcgattcttctgcctcggcctcccaagtagctgggattacaggcatgcatcaccacacccagctatttttttgtatttttagtagagacagggtttcgccacgttggccaggctcgtctcgaactcctggcttcaactgatctgccaacctcggcctcccaatgtgctgggattacaggcgtgagccaccgtacctggcccaaagtcttgattttaatggccttggtagggattctagaacttttgctatattctgtgctgcactgttgtgtatgaatgccttttgtttcacacgcttctttttaatctaacatacatgccacagaaaagaaacccttcttcacaagagatagaaaaatagtttataagatgctcctggcacaaggagaacagttataaacaggctggtagaaatcatggtcaagggatctataccacagagctgaagcactccagaggcctctgaagaggaccaaagactactgagagcagggttcagagcaaggagaggaaaacaggaagaaaacccgtttagtggcaaagtgctactgtgggaaacacagtaaatggcaatatatcccaaactgtgtgtaattcaaagcatcagctattcccctgccacctacattgttttaataccctactttaattaaaattttaattgcatattttaattaaaaatacacaatcttctggacctgtttcattcaaaggtcactttatttagtcttttctattttaaattactaccaatgttcagaaaaatcaaattaccccctcaggtttaaaggtaaaggcaatagactaccgtaattcttgattaaaagtatattaactttatccaaccaatattaaacaagaccctcaacacaaaattgtggaaaataaaattttgtatttaaaaaaaacaagagtcaccctacaaatttctcatctacaataagcattcaataactatgggaaccatactttttgctaggccctgagaatgcaaaggagaaaaagatctttctcataaagcctatattctgacaggaacacattctacagggtattagaagaaaatagagctaaggagaaaaaagcagcagggggtgagagtggggaggggaggagcagggctgctgtttaaatacaatggtcagagcaggccctatcctgcaggtaacatttgatccaaggcttgaaggaactagctcaagtctaacagtgaagatgtgcaagacgttccagcccaagttctgccacacccgcatcacgttctgccagtcctaccagctaaatcggccccttgtctgcgttagcattggttctctattattctggccctgatcactgctacactatcctaataggacaacccttgcttagactcccattaattccaaaaacagccatcctccaccaaaacattgtccaggagaacttcttaaaacacaaatctaaccatactctggtttccagtcactgtcagttttttgctcacttctactttcgctcatcttccaccactcctacacatacaccctaaaatgcacattcagttctctatgtctggaacacagctctccaactagccaactcccatgtatcctttgagactctctgaagtcatttcctgccacaacttgccccatccccagtgcacactgtacagtgctcctctcgactagtcctcccacagcttcttatattattccgttatctttgttatgtgtgtctggggtccatttggatgctccctcactagactgctgagcaagggcaagcagaacatagttcctgacaaggaggaccctaagacagatcattaaatgttctgtgaatgactgaatgaaaaacaaatgaaggagcagcagcatctgccttccaggagcctgtggtttaggagatagttgcccttataaacatgttcctcatgtccctacattgtaccagatggattacagaacttgtggagacaagatgctcaaatgttatagtaattctgccttcataaggaagtcatacgagttttaaatagttcatgtaaaattgttcatacgaaaaatttctacaaataccattaagatgaagtctcaattttaaaaagtgtcatctagagtaatttgatagatttacataaatctgttccacaaatcggtaagtatgaattatgggatgtcagcatataattttgttgaaagtactttttcactaatataattaagtctgctgagactattcatgtacaagtcaaataaaatgcagagtgaattctgtaaaaacctggtagttgaatcaacaataaaaggtgactacactgattgatgtgtatctattattccatttacagcagtagtaatgttttatgaaataaaagaataaaagccgtgtgaatctttttcaaatcccacagttagcagaaacaggtcactatggtcctctctgtcaaggaagacttgcaacctgaggtttaataatgcaatacttttaaaaagcaaaatggaaagattcgcttcctccaaacacagctcttgcataaaactgcatgccttaacgacaaaaaaaagcaaataatttgatttgcaaaaacaagttttcgttacaaagggggaaaatttttgtttttaataaagaccctgttgcctcctgatatccttctctctcctccctcaaacacacaataaagttgcaaatatattgtatttcttcagatggacttactgttcttgggcactcattatgtgtgtctgttcagacaggctgtgcactgcaactctggcaccaaagcaactcgcaccagacttcacaaaggagctttcttaatatctcagatctgatacacagcaaaaccatgtgggtaccacacagcagggaaaaggtttgagagaatctcagaacagagggatgcagttctctctagtcacgtttttctccacattttaattcctgacttagcctgagtctcctcaaatgtagcatgccagatgcagcaggtccttccatttaaacactcaagttaaggtgggtcaagttaaacaggtcttccttgctgccctctaatgagtaagatcaaattgtgagatggaggactggtgagatcctattactacagtccaagccagccttcctgaaagctgggagcatttctaccagcttcccaaaggacattaccagggattatcacaaggatggagaattcaacctagacactcacataatacagaaaacagatggctcactcgaagactcatcttccacccaaatgctaataaagctggcctgagactgaaaggccccaaagtttctaaatgattttcaggactttacagatacatggagctaatatagaagagtttaaatcataacttttctgctgaaatcaaagctgcaaatagtgatcatttggtaaatattacctaagcagcctaattctagagagagcggttaatgtcctcagcaccagggcattttcccttcaagttaattttaatagccatatctgtcccctgattatgcaactggtagagctctattttcctgtagttccagtcccagtaattatgaatctgctggcaatgcggcatgaccctgcttaagttggcgatactgtgggttcttaatatatcacattttcagacaacattaagaactcccacacaattcagtcttagactattgagaacagaaacagcatattaaatcctctaaattcttgccaagtattacaccgggtacacaaagatatcttgcatccaagaccaggaagatgaggaaaaattatgtgcagtaggaaaataaaccaattcctctacaacccacaggatgagactctacctgaaagcaggttctccagcctgaaagaaagtgactgagatagtgtagcacgctcagcaccacaatgaaaacaaaaggcggttctcatcacttattgatataggtagtttctctaaaagataggtcagcagttctaccttcaaacactggagctgccaccaggatagagcaaatgccaaaataccttcagatagcctgaaagtcatacctgacagttcaaaaaaggttaggacattaacaactctaggctagtccaatctactttcaattaaaagtttgggtatgctgcaactttctcatttctttgttaattataattaattctacacagatccgccaccgcccctacccccacccccacacacactaacagtcttatattatctgctttatcttgtgtttacttaaaagacaatggagttgttcaagtatataccatttgggatgaaggcaaaggaactgtattcctcaaaatagtattgtggtagaggaaaacaagttaactgtggtagtaaaaagggcatctgctgttgcttgtgcgaccagctggtgtcaatcttcacaaacatgcactcttgcctgtgcctgcacacacacacgcacacaccccccccactaagcagtccatcaagaggcagtacagcttcttaatgtgtttttctctctgtacaagatcattttttaactcagataccacaagaaacaaaaaatttaaaggccctgttttgaaactatgtcagagtccctgcaaaccaccatggagagctccccattttgtcaagaacgggaaactataaaattagactctaacaaactcaccaagtccatgtgaaacaaaaattctcgttagagataaattttcttcttgaacacatttttcttaaaaaaatcactctctcacccaaaagttaaaggttcaccagcccaaaccttccagtatgaaaaagtcagtaagtttgtcggggaaaaatgcccattcccactgccccataaatgctatgtctacctgtctggcagtcaacagtaccactgccaaactaaactatcaagcaactaggatccttacattacatatatcacatttaattctcaccacaaggctacatgtaaatacatctgtatccattttacggacataaagttggaggttcaaagatgctaagttaacttgctcaagggcacacacagctagctcaaaggagcagctgggtttccacactacaatcaacctttccaaactcagtctttcaaaagtgtacactttgttgcctttggccatgtgtggaaattactttgtggcagaatcctgtacatccaaagtttacaactttccaatcagaatatttataatctccaaatacatctgtatttttttcttgttctttgtcatgaaataaattgactggaacttcaattctttcttaatccatccaagagactatctgtgaaagaaaaaaaaaatgacctgaaagaaaaggaaggacatcctgcaggtgcacaaaccacttaagcccccaaaacaaatccatcattacaaaacagatagatgagaggtatctgcattataaaaagatccatttaaaatgggccttgatttacatactccttttccaaactcagaaagcagttcttatggctaaagccaaacatgtttgctactgccaaaacggtctcccacacaagacatttctctcctcagcagattgcattaaaatgctttcatacgcatagcatgatttcatagcggtggaaaaaagatgggatcaataccacatggtctctgccctctaagatgctcaaaaattttaagcccaacacagtaaacaagggagagaggcaggcacctaatgaacatgaaatacataaagtgcatcgcaggggtttcaggcttaaccaggaccagcttgaaaaagagaactctttagtgtgtcaaaacagagaagatgaaattcaggtgtttcctgacaaacaaattaaggtaataggaacatggagaagaacaaatttgtaaagaagtataaaagagacaagccaaaagcatactacgctgaacgtaaggcatctatgtagaggtaagcaaaccgaccccccatcctggaagcaagactggcccatgtgaaggtttacagcagacaaactgcaggatgcaccaagcactgaggcacaatgaggaaggaggcacacgagggacccagggacagtcaccttagtggcctggtataatcactgagcagatgcagatgtaagactgtaactagggacctcagtgttagaaatcacccacattctttttccttcttccctcccctctcaactctttattccttccctctctagacactcccccttaggcaatccatgcttatctacttaggctcttaagaaatcccacaggctaatcttgaaacaaaccaggaacagagtccccactgcaaaatcctcatgattaggaggagtcataattagtccaccaccactgagccaaagtcaagataatgccaattagaccttcagacacctgagagagccactgaacaagacacacagatcctgcaccacttctgcacgtctcccatacctttctccctttgaaagccctacggtaaatttttaaattgaagatggtactttagaatactagtttgccatcttctcagtttgctggctcccattaaaaatgcttttccttccaccaatccttgcctcttgtgttctggctttcaagtggcaagcagctgaacctgggttcggttacaggccttctagagtaatggccaggattgaaacctagcaactccttgtgtcccaggaggatccatacttccttggcatgataacatctggcctttgtaaaagtaactagaagggcaagaaaccttttgaaccataatacccagagattaatacaacacaccaactcagcagccttgaaagtattcttgcactataaaactaacagatatggataaccccaaccaccaaaaagctaaacccaagatgactacatcaggcagggcttacgattttctgagacctcctttacacagctgtaaaaacaagtacctcaatcctctttctgccccccgaccaagctaagctgctattatgagtggacaaagtgttaataactaccacagtaaatggggaaaaactactgcaagtgttaacaaaccttatttttaactgagtagcaactgcaaaattacacatgccttgtgaatgcacgtacatacctacgtccttcgcatacaatatggtgacatcaagttagaaaaggagtgaaagagggagggaagctgagtcattaagaagggaatattgggtagcatcacatgatcaggtgtttcaataaaaacatatttcaccttatgtgtactgatcataaagtatctgctatagaccgatatgtacaacccttccaccggggggaaaatgtccactgtaattccttttatatcaaaaagaaagagcagaattaaattagaggtatttttagcaaagacaaaggaagtaaatttccaaaggacatccatcgtccccagtcgacacaaggattaagtataaataacgtgatttttcttctctttgtacaggacatgttgcttagtttatagttaatgaagaggtagttaatcaagagggtaggaggaacatttttctttctttcctctaaacttaaaatagtcacacacagcactgatttttacatgcttaggaaaaattccaaaacagactgatggtgtttgggctggtgggggtataaatgctgagtataaaggaaacctatttaaatactacagacacagcttcacaaacctcaagaacactctctctgaagcaataaagaaaaggaatcctaatggaacacagtccccagaggaaattgagctgtacatggttaaagttgtaaaggctatgggtcagatgggaaccatggctacgaattaagtcaaagaggtaccctgacagaaataagtatcaattttgtttttgctcagggacagcttatgctacagcaaaccactctgagaccacagggcaacttgcccaccaattaacagatggctcctaaagagaagtacaaaatggtgcagctcctacgattgccacattcatatcacacataagcatttcttcccaaatcacctcatccaaaagttgaagtgattagctattgtaatcctccaaatttaaaattcacggatactttgaggaagattttgctaaaaagattttacctagacaatgattcattaggacacaaaagtaatgtggcaccatccacatcagcatggtatagtaaacgcattatcctgccgaatgagcagagcacagaggcttgtcttgtcttttaccactgactttaaagtatattaaaaacgaactatctaaatcatatacccagcaacttagtacatctgaccattgctgctaattctggatacatctttcctatgaaacaggaaaaacctaaacacaaaaataattttaacatattaccattttatcatctcaagtactcttaaatgtataacagggtagagggttaaaaaaatcttattcaacaacacttcaattttaattcatcttaaaaacttttaatgtgatgctttctttaatctgctgttactgaagttactcgatttgcttattcacatatctgagacccactcttggggaaggcgctatgtttttatggcaccagattaaacaatatgaaggaccatctgatgtgggaagtaacttctatacacagagcttctcagctatttgggccacattacatgcccacttggcaaacacattttaagattaaggctaagacaagtggatcagaagaatccatcttattaccacaaaggggtccctaaggaaaaggaggttaggagtttaaggcctccagctaactagccttatgaatttgagattgggatctcatctgtgggaaaagaaactgcactaaaggtactctctgatgctcgcccccacctattattctaccgtctccaccttaagtttcacaaatagattctgatgtgcgtgttagaatcactcttgttaaaagaggttcctacaatgtagaatgccatacaaaatgttaggtattcaattacaagtacaccactcgaagaaatgaatgttttactaaataactagtttttcagctcattccaatattcaatagcctatgctgtcaagagttttcctattttgttgctgaaaacttcttccttgctatttctaatgaaggaataaaatagttatatattataaactaatctcctttattcagggaaaaactttaaatatgtatgctgccagatcacttactagcccctgtacccaaacagaatataacctattaagtgcttattctagttatcctaattgacaacaacattattaaggattctacttagattataaactttatttttctcaagcaagagtactttctagcaagaaaacatatatatactgaaatggatcttaacacaaaagcctactatactattttgggcttctttatccttctcgcgcaccccccacgaaaaaaaataaaaataaaaataataattaaatctaatagtaaaggaattagaacttttacctcattattccctacaaagctaatttgttccttcatttgcactctctgtcattgtaatctatgacttaaagaaaatgaagcaaaaaaattcttttaaaaataaacaaaccaaaaaaacaggctgggcacagtggctcccaaataccagcacttcgggagtctgaggctagaggatcacttaagctcaggagctcaagactagcctaggcaacaatagggagaacctgtctctacaaaatatataaattagctgggcataatggcacatgtctgcggtcccagctactcgggaggccaaggtgggaagatcacttgagcttgggagcttgaggcttcagtgagctgtgatcacaccaccacactccatcctgggcagtgacagagcaagactctgtctcaagaaacaaataaaatacaaatcaaataaccaggaactatggtagatttttacaatccccaaagaagaatgttttctgaatgtataatctacagccaaattaagatattatacaaagattttctgtgtaatcctctataacctggtattatcttggccaggtcattcccctgccctacccaccaccatcttttcactttaagctacctgaacagatatcccattcaaatcctttaggtgtacacaaacatcttaataggttgcaaagaagaacacaaaattgactagattcttttttgaacaattacatttacaattcaccatcaatgacttacttgctgggaaaaaaaacatactgtaataaaggtaaaactagacttgcatcttttcaaggagaaccaaagactgtccaaaaacctaatgatgacatatactacttatcccataggacacagaaatataatgcctgtaagcatacacatgtccctacatggctggaaaccaaaagcgttaactgaagggttttaaagaaatgaccactaaataagcagaggagataaatgtaggtcattcagaggcaaatctgttttaccacaagatatatggctctccttagctactaaaagcaatgggagtcaccaaacattactgacctctgaagactaaaagctagagatgaaacattcaaaaagacctgctgtgtgaatgctactgctagtagtcatctcagtcattcttcaggttgttcttgctcacactcagtgagcaaagtagtgcccaagaaacataatcaaaagggggaggaagtcacaagagatgacttggaagggaggatcggtatcttcactgcacctactattttcaaaattaaattcaaactttgctttcctccaacactaacaaagtgacacaaatatgagtaaattgtttgaaaggcactgacaagtgactttatttacaaaatatgcatacatacatacacacctctcaaaacaaactcctttaccaatagctatggcaagttcacaacaggggcttctaaccaattacaaaagttattctcttataggtcaaattgagaccaatacaaaattaataagcttacttttgagttaaaaaacactgatagaaaaagataaaaaatatgaattacataaatattgtttcaatggagttctagattgtacactgactctacctaactggcacaaagaaacacactggaagagtcacagagcgttttcagaatgagtaagggctgggaaccagacttcaaggagttaagtagtaggaagtaaaactacccccacctcagaacagagaggtgagtcatcatcaccatcttatccttctatcacttccttgagaccctaggtcctgagataaaatgcctaattgactttacttcggttccttactggctgcttgcctataggcaggcagaaagagagaggacccacccaactggcttctggaattagctttttcccatcagcaatatactaagaaagagaattccccaatacagaaggaccctaatgaaatgtaagactgagacaagtttgtcttggatccacgaacatccttagaagtctttccatgtaaactgaaaaagaaaaaaaaaaaaaaaagcctctctcatttctgttcaaataaatgactgcatccaatattaatcatcaaatgaaataatcaacaaatcattagtggaccagactatactttacatcttcgctcaacaaaacaagcaccaatttagaacatcctgcattccaccttcacagtatgacaattccctccttctctacctcccttgaaccatgaggtataccacaagaagttccactagccgagtacagtagtcctccaccccctaccttatccttgggggttacaagaccctcagtggataactgaaaccacagatagtactgaatccaacataatatacactacttttttttttccgatctgttaagatggattctaagtgattaaaggacagggaacatgtaccagccatggataatgtggacaaagggatgattcacatcctgggcaggaaggtgcaaaatttaatcacgatactctgaatggtgagcaactcaaaacttatggattgtttatttctgggattttccatttaatattttaacactatggttgaccaccagttaactaaactgcagaaagcgaaactgttgataatgggaggactacggtatttcatggcacaggctctcttcaacagatagtcaccacttgaaatcaagaacttaacactggctgatattctccagcacacccaaagctcagacaaagactactgaacaactggttaagcttgagtcatctttaatcaagacaagaccttacagctccagaggtagaagaccttcctcatctcaatcagaggcttttggaaactccctacaaacatgagtgcaaagtaggcagtggggataagtctacacaaagcttgcattaagacttacccatgaagtattcacctttttcattattttaaactcttacaacccaggggaggctttctgttaagccccaacacaggaaattgcttttcagttgtcaatagccaacgtctgaaaataaatccagtcactaagtgtggaatgatgtacttgcagccaacatgcatttggctgatgccaacagagaaggcaggaggccaagatataagacctaaatttttttttttaaaaaaaggactgttctactcagtaacagaatctgaaataatgcaaaggcagaaataggccacaaaccacctgcctctctagcttcaacatacatcagcatctgtctcccaaggttgcttcagaaagatatttaagttttctctaactacaataattgttccagtggtctaaaaaaaagaaatggctctgtcctgtgggtttctggttgggtggttgactgttatattgatggggggcttccttgaggggtagggggaaagagtactagggaagggggagaaaaaaatggaagaactaaaactacagaagagaatttctaactcgtcgctctttgactctgattgaggaatggctttctgccaagatttccttcaagtgctcagcagagaatgaagtgaggtaacgagaagtagtctggggatgttacacactgtgtcctgtgtcccaagaccccacacggatgtttgtccctggatgctctgactctctgggagaaaagagtagaaaagtatgaaggcagagaagacttccagggagcaaaactacttgggttcttctttctgacccactgtacatacaccaactgcctcttcctccaggtaacttgccaagatggggagtgataagagattgaaggcaattttcaaaagaataaaacaagcttgaaaccaggcagaacaactgcaaagggggtaagatgaagtccctgcaagtagtcagcaatctggcaaaatattgcacaaattcagtattttaattggacgtttcttttacggggaatgtggcatgaactaaatttgaagccaggctacttatttcagggggaggggttggtccctaaagccacttggagaggaagagaaataaaacatacagaagagtctacagcccaaggggaaaaaaactagtatctcctgaaaacaattatcataatttactttcaaaatactttggtatatcaaatgttgtatgatttcatttatatggggtaccgagaataggcaaattcatagagacacagaaaatataatggttaccaaaggctgggagcaaaggaggtgggtgaggagttactgtttgatggttacagagtttctatctgggatgatgacaaggtactggaaatggataagggtgacggctgcataatactgtgaatgtgcttaatgtcactgaactgtaaacttgaaaaggttcaaatgataaattttatgttatattttgccacaataaaaacatttctttttaaagtttagaattaatctgatgacacgtgtgcaccagccatttaagctttaattctgggtggtcatctaacatactatcattaatgcacaatccaggattagttaactagtataatacaagtaggctaaaattcaagtgactagtgtaagcctacatactatccatacctaaatcaacaaccaattctctgctgattcacctaatggatgtcaaaatagggttttgttctgtaagccagttatttgttaattagcataacgagtgttagaaatggagtcttaccggtaaaattaaaggagttcaagatacgcagatgggctaaattagtttagagacacttcccaccttcgtataaacagggcacaaaatccaaggtggcataatccaaggtggttatatctttatggagagaacccctaaatgttaaatggtcctgggtttcagtctttgtttaaagggatttctttttgcatgatgcaaagtgagggtgcagaacgtgacttttgggatattgttagcctccggtgaacatttcatttaaagtgtgttcaaagcacttaaaaaagaagagagaagtgggactttaccaagctttcagaaaaggcttctccatcaatttggtcctgcttgctagatagaggtttctatgtgtggtgggatctggcctgagaccttctttcattataatctatagagcaactaacgctcacccttcctcctttggtgcctactaacaactacgcaaaattacctaagagctgttattcactatactaacaggtccatttaataaacccagtctcaaggagtcactggtcatgaacacagtggcctccaagggtactgtcttaaaaaaggaaaaaaaaaaaaaagactctttaaaagtcggttgtccaactataaaggctaggaaagaatattagacatcctccttactttgatggctatatccaaatatattgttttctataagcattcagagaactaaaatatcaaatagagtaagaaactaaccccagaagattccatattctacttttaagtagcacatcaggactagctttgtatgttctagagctggggatataatggaatgttatcacgcctttttgcaaaggctcccaatttccagcacttaaaaaaatacacatattgatataaaacacagtaacaaatcggtattaacaattctgtattttaatcctattccaatatgtataaaagggcttacccccataaaaaaaggacaacaaataataaagaatataaaggtctaaaaacaaacctggtataacattgttagattttaagatattagatcccaaatcattctacttgagaaggtagtacactgtctgcaccatataatggcaaaatcacttggcaccatgtttaaaaagagctaacctaatactcaggttcacaaaagaaaaaaaagacaattttagaggcaggatttgggaagtcatttaggagagcccttgtctacatgagaagatgtcaattgatttgatacaccatcagtctctcatttatattcaaaatgtttagatacatttaaagtagaataagagcaaactacaattcatttaaatggaatgaaaaaagctcccatggcttacttagtaccagggttaggaaaaaggattcgtacgacagtacccttggaggcaactccttaagactggatttaaagcattaaaatgtgaggaaataaaactgttctctcaggctccagtgaccttaaaaacagtgcagtgattctgatttaccagtttacacacagctatgcctcccttaaactttactttaaaaggaggatttgactttctcagtattaagtccaaaggtcaaacaggttgtaaagagtcaagggccccatcagatctactctacaaggtaataaacattcaagtctatcatccctcaccaagaaatgcaaatttttgttgagctagaggatgggagttgggggtggtggatacaggacttgtacgccatacacattttccctacaaaatcaaagcagtatgtacaaaacagagttccaacaaaaagtacaatgatgagaaaagaactcattaagagctaaaaataaactctaattcacaatatgcataaggatttaacaaaaaaggaaaacaagatgtaaaattgcatctgctaagttaaccataccctcatggaaactgccccctcccccatacacacaaactgaaatctgtaaagtctgtgatgactgaatgaagaaatgctttagatgttttcaatgaatatttcaatggaaaagaaaacaaagggatagtaatttttttcctcagccttctgatctgctaacactgcaggaatattaggtttttgaacatcccaaaacacaggtctctgtatatctagacttgaacatcatctttgataaaatgagactatttagtatagtatttacgttttatattaaacggatactcatcttaaggaagatgatgtcaataaaagtaaaaataagccgcagttggtttttatctaaccaacacttcatggctcaatttaacaacttgctgaccttcgaaagcccagtaatagctcactggaaagctcacttgagagcaccttcatattttaagtcaagctaattcattctgaaacattcacacaataccacatagagcaataattccacactccggtgctctagttcataaaggctggtgtaatatcattaatcatcattctgggctcccaagtcctgcctcgcactttctattcttactttgttccacccctggaaaatcaattatgttggtcaaatcacctagaaagcaaaggatggaggatgagctttgcattcttcccacatcatgacaaactccaagaaatctaggacaacagatctacttcaagatgtttttcaaaaactactttttacctatggggggaaaaacaaaagtctgcaactgtcacgtaactgaatgggtattaactggtaagaagaggacaggaaagagagacagtacccctgtgtgctaggtactttatgaaagaaactgacgttcagagtcaaaaagcacacacaggacacaacacaaattgagtggctaggctggaattggaacccaagtgtaacaatgttctaagctaaaagctctaagattagtgtccagtaggccacctccctagcaggaggaagcaaaggtattttgattcaaacttaatcccaagaacttgatcccaaactaagtaacaaacctagtgtacacaggggtttagtaaatcctactaccacttaagaaacttttttttgttttttttttttgagatagagtctccctctgtcatccaggctggagtgcagtggctcactgcaacctccgcctcccgggttgaagcgattctcctgtctcagcctcctgaagagctgggattacaggcacccagcaccaagtctagctaatttttgtatttttagtagagacggggtttcaccatgttggccaggctggccttgatctcctgatgtcagatgatctgcccaccttggcctcccaaagtgctggaattacaggcatgagccaccatacccagccaaggaactcttataaacacagcttaaatacttctgtcttgcttttttcccccttaaaggaggcataaggtaaatctttgttctaatttagaacaatacagaatgatcacccctcgattacataaagatgatatatggtgtcagaaattactgagtggagtctgaaaagatggttttaactgcgaatctgtttcttcacaacacttagagcagcaaatgctactctgtgatttacagcccctcaaaaaatatttgattacatttcccaacaccaataaaaggggcatccaagggttttgaaatattgacaatctaaaactttaaagagccaaaacaaataccttaaggactaaaacatgctaattaagccactgtatagacctgacaaatcgaatgacactcaaataaaatgccagaaaatatctgttaaagttgaccttttgagctggaaaagcacactctgagggtttccacagctctcaacgttcagtagcagcagtgtactcagctgaaagtcaattaacttagaacaagctcaaaagaagttggcaaattttgaagcacagttttagctccaataatcaactattctgttcaggaatatttgaaaggaaatgttccaacaggtacagaataaaagtgcttcggtctattctgaatttaaacaaagttaaaaaaaaaataaaaggctggtggccaaagctgtgtcatagttaaggtagtgaaatagaatgaaaactgtcaaaaacaggttgattttgtactacatcataaaaatggggggtataaatcattttcataccaaagaaacagaattttaaaattctataaactacaaaaaaaagaagcaacaagttcatatcacaatttaactgttttttatcttctaactgaactatttccattttagttcaccatcttcctcatcgacattttccatcattcctacgacaagcgcttaaattgagaatggtgtctcttctataccaccaatctcctgatgcaaagtaaacaaagactaccccccagaaaaggtctggaatagcaaacagcacacgtgcactcttatgctgaattataaaggggcaaatgttacaagagaatttcaactgtaattttattttctatgaatttgaatatgtttacaaagtttgtgttttctatcaaaccagcaaagcaacaaagagaaaggttactgaagactattcctaatctactggtaaggcaaatacggctattctaaaagttcctctgataagggctaggaaagcacaaaatcaaaactcctaaacctcatttacaccataggttcaactttattttcccagtaaacactctaagacagctgttggaaaactgtataactgtctcgtgggagtgacacatatttttttttacattttattctaacggaacaaaataccaagtaacacaaatatcaatatcaggaaatcagagaaacaaatctggatgattaatgaattactagagaagaatattgtttcatacttttctgtatcctcaaatagatgtttcttcatcctagcaactagccattaaaggcttcattaccacaggttatctaaagaagcagctctttgatttatgaagagatgttaactgggaattaacttactgaatggtgaaaaggtccagatttgccaccccaaaatattccactttggcattaagttttttttttttattatttttttgtgaaatggagtcttgctctgtcacacaggctgaaatgcaagtgcggtggcacgatctcagttcactgcaacctctgcctcctgggttcaagcaattctcccacctcagccttgtgagtacctgggactacaggcgtgcagcaccaccacacctggctaatttttctattttcagtacaatcagggtttcaccatgttggccatggttggtcttgaattcctgacctccggtgattcgcctgcattggccttccaaagtgctgagaatacaggcatgaatcactgcgcctggctggcatcaagtattattttaggctgaggaaaataagaagtcaacagatgcaagatgagttctctgccctccccttttctccctaaaagcagagtataaatttcccatgggaagatgtctctctgtcctgtaccagttcagaagtaagcgactcattacttgagacagtcaacatcagattgtttatgcatacagttctgtataaaccaaccttgttaaaagtgcccttatcttgtcattacttacccctacatattttctgaacgcttccccatgatttcctattccgcaaagtccaaacctttcctttgttaaaatggtatataagccccccaaccctgaccactttagttttataatacttttctgtcaactcccaaacacaaaatacgagcaaaaattgtgtgccatttctccaattaatttccaagtccccaggtactaaacaaaagaggacagaagttgtttttcctaacaatgataaagaactgtactgtatttgatttcttaaaatgttacaaatttctagtttcatcatcctgtaatctttccactaaactaatcaaggctgacactgaaaattgttctataaaaatacccaggttcaagtaaaaagtgaacctagaagaataaatgttaaagactttctccaaaattttatatgaagcttctacagtgataacaccaaattttttaaatgactgcaagacctttggcaaagaaacaagatataatgaaaaaataattaagtttaaagatacatcaatgaagatataaataaagtttctccattaccttttgcctatgagagatgttccaaaaatagaggttccacaaacttgacacaaatttcattttatacaaacttgggcactaaaatctaaaaatagattcaaatgtactgtattccacagttaacgcactgcggaccaaagcatttacccctgtgcaggcatctcctttcctacagacctaagaacacacacaacctttctgccatctttctaattaaatagcatacagagtttgcaaagtgaggtgtttattaagttaccacccacccaaccaccctgctgtttccaactactggtctgcaagaatcagaattcttgatctcttgatactatggacatttcacatgctcactgtacaactgtaactgacatacaaaatcacattttcaaattaatgttcatcaaaacagctttgtgttcactgtgattgactcataggaaataagtgctattaaatttgaaggttcccattagtctaataaaataccacttatctgtttcaatcctgaggagctaagattgtatttgtttaaaaagaagagaatcctatgccattaaaatagtttggaaatcacattattttgatagaataaagaaggatcaaaactagctgtaaaattctcagcaagcagagacacaagataaacctagctaagaacactcatattaataaaaaatattttaagatactagccctaaggcgtgctggggcatggcaggagccttatcatgcaaggcactacctactcagaggtaatcaacatctctttgggccctctggaatttatatttgggtttttgttttttccccttttgtcaaagtttctagttagcagctgatgaggtcagtacaagacctacctcaaacaactgagagtaatggtgaaatactcattacctgaggtcttccaccaactactcctctagccattcttttagaagaaaggaaaaataacagtgaaagaacaatctaccctggagtttcaaaaacctaattacacttaaacacacacacacacacatgctcgcacacgtgctttcagcaacatatcagatcagtaaggacacagcctagtgacgtaaactcaacatgtctagttctgaaagctaggaattaactcagagaccaatgctgaagaggggacagcactttaaacttaaactttccaaagaattaagtactgcaattgttaacacctcttccataacgccctaaatctagaattcaggtaaacctggaaatccctggttcaatctccctacaaaatgtttaagacattgataactcctagctaacgagtaccttccaggtccccactacagattctgattcagtaggcctggacagagcccaggaccgtgcatttctagcactcattacaagtgattccaatgcgggaatcctgtgaccatacttcatgagacacagtctgattcccaaaacttttttgggcttcaagatcacctgggaagctctctgacaacagattccaaaactcccttaggtgagtaggtgaggatgtagagccaaatttgggtaccaccgggctagaatatcaagttcacaaccatagattataatgtttctagagaagcacagatgttcttgttcatttggtgtattcgtcagtccttactgtcaaaaaccttccattctccttccagagaagacacactcgccagaagatgccctctggataactctgtaaaaatcacacatctctctataaattcatcagttggccatttgcttcatctttaaagagtgagctcttgcctccaacaagtggcaaagaggaaacatccaggtaaagcataagataatcagaattctggtccctactctaccgcttaatagctctgtggccttgaactagtcatttcacaaacctgggcctctcatcacctatgatgtttggggcaaagaagggagagggttggttaaggtcacctctagggcttttctgactgtaacactttattactcattccttgcatcataaaatccatttcgttcatctagaatgcagcatcagcaggtgtcaaggactcccaagtgcatttaaaaacgcaaagggatggactaaagtcagctaagctgtacaagcagcagaagcttctcatgatgaatgcctatagataggaaacaggctgaagcatacagctgggcagaagcccaaagagacggacctgacaaataacataataaatagaacttagtctagagagaagattattgtatttgctactgaagacatttcttaatgtacttccctaatcctcactcgatcaaaatagtgacattaatttgctaacactgacacagtctaaaagttatacactctcttcaaggacttaagaagcacacactttcctaactagatatttttgttccttagatatagtttcctgattcagcattaagaaagatttaagaaaagggaaaaggaaagatttcaaatcttcctgtagagtgactccagagttttcctgtaacccaattaacgcacatgctcctacaaaatcggaatacagaaatgggtcccaactgcttcccaggaggtagaataagctggataattagagaaggaccaaagaactctggtctgtccctaaaatacgtactgagaaactgcacaagacgggtaatgctacacaccacaggacagggtccaaagctccacaaattctttcaaaaccttgctagagatacattagtactacctcttacgaagtatgcctacttttcaaagtacaaccactcagaacccagatttagatactaccattttctagactattttactcaatagaagtattcagtaagaaactcagaaaaaaaaatatcctaaagcagtttatgcttaagttaaatgagtgagatccttctaaaagccattttaacccatattacaaatatgtcagtggtccaaatcaaaccaagattaccagaagttgagatgcctagtgttcagatttacctactccacttttgaatttattatcatatatgtttcttttaggaatcatgctcatatgttattgatgtgaacaggttaaactggtctgataaccagttaacaacaaatgatttcaaaagcttttatagcaccatgttcagtgtaatctactgtcagggagagatactcactcttcccacagtccccaaataggctctatgatcaaataaggccggggaactataattcaaacaggttttctttactgctggatttttcatagttcttaatacagtgattatcgagtatggatcttaaataaagaactacagagtgcagcacttcctaaacttgtctgtcaatataatacttatgttaagaaataattactagtatctcaccaaatgaaggttgaaaaacatctttcaatcttatacacactatcgtgggaaggcaaattaatacaccaaatacactatgaaaaatggtatgaaagttcctcaaaaaattaaaaacagaactaccgtatgatccagcatccccactactgcatgttaacccaaaagaaatgaaatcaatttgtcaaaagggatgcacgcatatccatatttattgcagcaatgtttacaacagccaaaatatggactcaacccaaatgtccatcaaccaataaatggataaagaaaatatgctatatatacaaaatgaaataccattcagccacaaaaaagaatgaaattctgtcatttccagaaacatgggtcaacttagaggacactatgttaagtgaggtgagacagccaaataccacacgatctcataggtagaatcgaaaaatgctgatctcattggaggcgagagcagaatagtgggtaccagagggtggagaagagaggaggaaggaaggagggggccagatggttaatgagtacagggtcactgttaaaagaaataagttctggtgtgctattccacagaagggtgactatggttagcaatattgtatagtatacttccaaatagctagaagagaggattttgaacactctcaaagaaattatgaatgtttgagatttggaaatgctataataccctgcttgatcattacacaatgtatatagcatcaaaacatctcactgtactccacaaatttgttcaattatgtgttaactatatacaaatatatactatatatagtagtgtacacgtaatatatatgtgtatacatcatatatagtattatatatatatatatatatatatatatatatatataatgtatagaaacgtcttacatctttagaaacatctttcaatactcatgaccattgtggaatttcttggggactctacttgcttaccaaatatttttaatagaaattttaccacagtggaaatctccattacatccttcccctcaagccactgaaaagacaacaggcaggggtcagaggtgaaggaaatggatgagaaatatttacacagttttttagtatctaggtatgtattaaagaatacccatgtgttgtgcttctattaccaccgtctaccacactaaagttagagaggcaaaggaggtgaagataaagaactcaaatttatcccattttgccacataacagctctaaagattcacaaaagagtaagattaattcaagattgactagaggtgagacgtgaggatctgtaagatgtctcctgtggcagatgcctaatatgaaagatgtatgatttgtctaatattttcatcttataaaatgataaaatgtatcatttcgtaacagtttcataacaaaacatgacttttgtgctctgttcatgcatctttctttttaatagtaaggggagctctactaagcaatcagaaattgcatcatttgtgtcatagccctcaagtcatttatcatatttttatcttttatattaaaaaggttgcaaaatccacatgtcaggggtgttgttttactttaaaaacaaaagataacatgtttaaaacatgttaaaaagatgtttaaaaacatcacgacagagacgtaagagcagccttttgttcttcacctttttcaacttattaaaaacactataaatttcacatatgcttatcacactcattttggaaaagaaattgaaaaatctcatccatctgattatcagtgttcagaaacataagaaccaccttcctaatatcatagtgaacatttaagcaacataattaaaatataatggccgtttgctatggatcaatgacaatcagtttgtacttagctttttaacttgatttcagtaagttgtctctgtgaatctcaatctgtagcttgaggaaatatgattatgagccaagtccaggggctggctctagaactcacttgcagatcttggagagaatgagccctaacgattaacggaatagctcaaagtcccatgtatgaaaaagtcaaaagtgaacttagaaatggcccagtgttaccccctttttctctgccttttaccttattttgccaatggaaaccagaagtctagggctgacttatccaatgtcacatgactaggtgagagttcagactcctggtctcattcttcacactgcctttaagtatcttttactcatttcaaatattccattttatatttttggttataagctttgtaaagcaatttggtatacactatcaatcaaatttaattaacatgaaaagtccacagagtctgtctaccttcgtatatttttagtgtttaacttcatatgtatgtctaacttcatgtatttttagtgtttgaaaacaactcctgcaggaagcattaacccttctatcccaagaacgtgctctttaaattaggttttggtttactctaaaaatttagtcaaatcttaaaaaatactaaggagattttcacctaatattcaaaatgtactataattaaggctttatctttataacaagaaggacaatcatataccatgtcctttccttgttaaggaacggaacataagatctcatcacgcttggtattatatcagtgaaaatgtttatacactgacaatgtgaacattaccatttattttatcatatataagcaaaatgattatattaacataaggaaaacacattttaagattttttcccctctcccaaacacatattgtatctcactgttgaaatgctaacttaaatacactcagggtactaaaagataaaagttaacatgacactggctatcccagatacatatacttttagaagattttccaaagatcctgtccagatcagagtacattaaagtccagttaaaatatatactgcccccaaaatagtttatgatttaaaaagaaaattttaaactaagtttcatattgctgatgtaataacagagagaaaatctagatatgtaaaattgcagcagtgaattatttacaagcagtaatcttattattttctcctatcttgagacacgatccgttaaatataaatcatctacataaaactgcttacctgttattttgtctcttacaagcttacaggactctatttcaccaatgctcccaaagagactctttagttcctcctgtgtcatgttctgaggaaggtagttgactattaagttggtcttgctgtcttctgtgttcccagagtcaactggtgacgaacagttgttgtttatggtggttggaccattggctgtgttattgcaagttggcccattagacagttgtgtttccatggcagcaattacctgctaaaaacagagaaaacaagaaatgtcagaattcatatttcacaacctattagagactccatccaagaatttaaacacttgtcactaaacacaagtcgttctaatgaaattacaacaatgcttcaacaaaaagtgtaatacctacactaattttcacttcatattaacctattcatcttaaggttacaactatattttcacatacatattccatacatgcatataagcacaatttaaatcttaaacattttctagaatcacattctgggtctattcacatatccttactcacctgcagtgtccacagatgagaaaatcaagtaccaaagggcacagaattgaaccctaactaaaaatcatactagaaaataaaagtgcttaacatgctacaaaaatgaacaaaaaaatgacctacctaactctgaagagattttcagttatcctaagaggttcaatattctaaaactgacagatagccattaacttaaaaatcaaagagcaagagtacttttaaaaatataaatttgtcaacatgtactgttttggttacatattgaaaacgtttttgatggacaatatcttatctctaccattggtaagaaaaaaacagatgctatattttagggagtggaaaggaactaactgtaaggtaacttgggaatgagctatgaatactttgtctaactggtagaatctaataggacactcctgtcaaccttggcagctaaaaattaccaacaaggtgactgatctacaacatcaaaataaaatccccaaacacttcgatatggtgtttctccttgactctgctttttaatgagaaaaaagaaaacctatccagtcaatgaaaacaacaatgtaaatatatcaacttttgcaaacagaccagcccaaggaattctcgtctgagcacataagcctgttgaaaatgcaagtaatagggtatctataaactccaaacaccagataaagaacagaattggggaaaatggcctcaaactgttcaggctactctacaaatcacttattaagcagtattaaatctagtttcctaaaaccaatcctatgcaaaagagtcacaaaccacagccccaaattttccaaaatcattttccactaactacctatctttggacagccaagactgtggtggaatctaaaaatcaacgcatcactgaaaggattatccttcatattgcatacatctctcacctccacaaagaactgcttctcaaaactgacaattctgaattgacgggatgctagttttagggaagctttaacatagaaaaggcaaagaacttgaggcaaagaaaaaaagcaaagtaaagggaaagagggttacaaggaaagagaaaaaactgtcttttaaaacacatattgcctaagaaaaataaaagggcacattagcagataaacatataggaagaaatctctactgccaggagatgtttacaaaagaaggcagtgttggacatattgagactggtcagactgaacaagaatcagtgctgtcatgataaaaaaacatgaggcaaaatccagaatagcttttgaaatatccaacaacctgtaacccctctgtgacttcatttccttgtcaaagaagtgggaatttattctacaagctgcaagctgtttctctacgtaagctaagttttctcagggaatacttaaagggatgaaggaaaataaacctttggaaatctgtatttaaaaatcttaaataattcaagatatgggttttattataattagcaaatctatttgaatttgaaaagggaagtttcagatttcctaattaaacataactgttctggtttgtagaatattagctgtgggtcactcttttcacagcaaaaattcttctggggttaacccttgcccagcagttatggaaacaatgagctacaagattaaagtggccaaagacacttaaatcactactgaaaagtttggatgggtgtagaaactacaagagacccgaatgggagattcggactaaagctcattgggatagcatttgaaatacaaagtgttcattgactgaaatcagcaagatttagaaaggacaacaaacactcctcacttaattgcacatttatttccatgttcaggtggcaagaatgagctcctaagccaacattcaagtgaacagctgcagtaggctgtgtgcgctgaaaattacagcatctctctgctataggaccatctgctcagaataaaatgatactaatgtgctatattttacaaataatgcatattccattgataggctcaacacaactgttcacagaatgcaaactctttcaacagttactgggcaaataattttcagccagatttacaatttcaactttttttttggagcataaagaattgtaaataacttcaaaatttagtaaccaaaaaaatacatagtaaacagaatgtatagaattacggtaacttagtattcagaccataccaaaactttttttgtttttttaaaaaagcttgtcactcttttgagtctgcgctaaatcctaatttagattgtaaaaaaattacatacgagagcatggttctgatgctacatacaccactacagttaaaattgcaatgtgctttaagtcctaatgatggccataccacaataggttaaatgtaagaataattagtatgccaaatgaaagattcaagtgtttggtatggcctcagcactcctccaacatgctaaaaaaaagtagcctacagaatttaagaaaaatcccacagaccccggtccaaggctctgctgcccacgaaccacttctaagcagagaagccacatcacacagtctgactgccatgttagtttggagttgccgtctgcaatatggacacaaaaagtaccgtatgttagatgagcaagataatgcaacaaatcagtttgtacaaaatttacagtgattgtattgatattcccagcacgtccatgcagtgtggcttaattgaaattgaggcaattccaatctaatctttccaaattcatttcaacatgtagttttcttgcacaaatataagcatttttaattaagagcctgattttaaaacagtattaactagttatcttggcatctattctgaagaactaatgtaaaccacacctcaaaaatttaaaaaataaagtaaaataaagcaaaatactgcaggctgtcttatctcttaaggatgtgggagaagggaggaaatgtgaatgaaattttatagtgggaaaaagtcatcatgcaattcctaagtgattggtttgcataaaagcactctttccccaaaatatcagaaagacattaagagaagctatatttgcccacactgttacattatactataaatgatccttaatcctgggacttaaaattaaaagtgaatcgaaaccctgtgaggttattttgccactacagtcaaacggtttctaacagtttcaatgagaattgctcacatatactaagaggcagtaaaccagcatctttcaattgaaataattggaccgataaataggattgtttggagtaatgctcgcataggatgtcagctttgtccctgaacgaaatcaagtgaacattttttaatatgtaaattgtaaacccagcacgatttgaaattagtgctgctatgaggcctccaatatagttaatgggccatttaccacttattgaaacttgcccaaataccaaacagagccatgatattggcacaaaagccaaagtttactttttttgccatatatgcagatgcttcaaatggtcaatataatcagaaaacttagtttctaaaaatagacagtgaataacagaagaggtccaaaaatgtcttttacttattgataattataaaaattttatcctgagaggcaatcctggctgtgatttactcttgatattagcaatgccgccagtaacgatggattccactttctggcatctatcaaaaaggattaacatacttttttacaggaagccatgaaaatattttactcttcttccgttctcccactgtaacaagagattttggtctgaccctatgttatttttcaaaaaactacttatagtttaactgaacctgtgaaaaagtgctttacacccatgaaagatttttcataagaacccaactgtagttaagactacatgagcaggaccacacccagcagggtaaagcaggcataaatgtatgtcctgaataccttcaggagttcaatctaaacattgctcactacataaaacagattttaatttaactgcctcagtcccttctatttcataggaggtggacactaatgagctaatctattgacacccctctttctgaaagccccagggaggtgaacaatcactttattgcaccaactagataggaaggctgtgtatggaaaatgattctactgcacttttacatttcaagcaccccagacagtcttctccgcttgaggcagacacatacctttatgggaagttataaataagttgctcacatggcccttacctttatgctggccaacaattcagttactaaaaatgtaaagctacttccccttcacttaaggacaggcaattctgctctactcaatctaccacagacaactgggctgtgtactatttatagattccactggctctgaaactcttcggaaagaaaaaaaaggccatattccagtgaaacagagccattaattttaaggcttaaaaaaataatgtttcaatatatattctcctcttaatttagacatcacttgtgccaattcagactgcttttcctcctgttattatccaagtaataatttacgaaaaggcactttagcatagatgaatctagaatattctaaactttcactgggctccaaggtaaaatggctgttactatggtgaaagcgtaggttttattgggaaatagaagattgtctctacttttatacacacaggtacttccaaaaagccataaagacttctaaactttttatttaaataatcctttatgaattttaacatctactgttttcacaatagtggaatttagaaaataaatgctttatatctcatatctgggaagagttaagaatttgagaagtcaaactgatccaatagtttcctggtcacatgagagaaaagcagtctatattttctaatcttacaattaaaaaattctgcaaactaaggtaatcagcttcttcactattttcaaacctcttgcagacagccactaaaccaggtagttaatcaaaagcatcttaaataggccagactcggcggctcacgtctgtaatcccagcactttgggaggctgaggtaggtggaccacttgaggtcagaagttcaagaccagcctgggcaacatggtgaaaccccacctctactaaaaatacaaaatattagctgggcgtggtctgtagtcccagctactcaggacgctgaggcaggagaatggcttgaacccaggagggggaggttgcagtcagcagagatcacaccacttcactccatcctgggtgacagtgagagactctgtctccaaaataagtaaataaatatatcctaactatattctgagagttgttattaagttcactcagtataatgttgcgaggagggaaaaaggttccatagcctagaaaccacctgatttagggaccagacttctgcgggttaaagtcatagcagggctgctgaaagggccaatacaatgacccctggtgaggctgcgcctgttgctccagccactccattgccatggtcaacatcctgacctgggctctcatcttcttcaggaccagcaaattaaagcctccaaaaggtccctctctcctcatcctaatctaccttaacaatgttcccaggtagactttctaaaccctcccacagctccctgctgcctatcaaatgaagtgtaaactactaggtatcaacagaaatcctgtacaactacttttatcagcccacttattcaagcaccttaagatctgaactactccttgtccctcaaacagtccagtaccttcactcttctagctttgtttatgcagtcccatctcccttattcaaggctccatccaaacccaccccatctccatttcaggggtttgtacaaactaagcattgaaaaagcaaagggcaagaacagtttcttaaaaattggagactgaaagagcaaatccctccctaaatgtgtacaaactaggtaacttttttttttttttttactttttacaaatacatttaaactataaattggaaacacaaataatcatgagtggctctaacttgtttttctatcccaccaagtatttcaaaccagaagtaattatgaaagcatattttcaagttttgacgcactccatcagccaccctcacccactgaaatctaaattcctattatatggtaaaaggaaaccatctacctttgtgaaaagttgtgtatttttatttcaacaatctatcacactaactacaaaaccctggaagacaagacaaatccaagcctctggccagcagggttatggatatgggcatgtggaatttgggtccaacttcaggaaaatggcaaaatcaaaggtaaatgcaggaaaattaaacagatcttgaagaaggcatttagaagcacatcatgattaagtcgtggatcaccagtgatcttcatactaactagaaaagtttaggcaaacagaaacgataacatctcttaaaagaatcatggctagaggcaaagacaagcttatctctcaggctggaaaggtccagcctaaacagagtgaacttggtctctacacttatttgcaactagaagctttgaataccctgagtattcaaacacagcacaccaggacagaatcagcccagtacaaaggccttccttctgaccacatcaaacctctccctaaatgccaagttacagatgaacagaagacatttgtctctaaagttttagagccaaacatacaaaacacaaacaaacaaacaaaaaacaaaaccaggcatcacaacctttaccacaccatcctttggggaacttgcagcagggacaaaagcactccaaaattggtgaaataagtcatatgagcttatagatgacagctgggtaggcagtcaaagggatcatctgcccgacacacaccattcctatagcaaatgctttatctttcccattcaaatcactaagtggtattttcaggatatgtttgtggtttcacttaattaagcaagagaatagtcaaccaagtgctaaaatcacaaggctaacaatgtcagttacaggaacaagccattagtttgttttctttaactctctttgctttgtgattcctaaaataaaggtttgtagctttaaatgtcaaaggatttattcaatctagaatccttgtcaattctccagcccacccacataccatgttagctgtctcactagctctacgaattcctcaaacccacattttcagccttggggctaacaacggcccaagaacttgcagagacaatgcactgaacagctgcacgcgtcataaggagaatgttctttggcagcaaacactaacgtttttctgtctcttggccctttatgacttctacggacaaagtacacagtctccttcatgccagtctttctgaggttttgtagtttcagagctggcaggttcaaaagctttgaggttagagaggtaagataatgagtttagggtcccaagtccttctcttcagtctaagtccattacaggtatccagtttgagcaatgggaaagtaaagatctggcgaaaaagatctgcttaagtttcatgttttgttcattcatccattcaacgaacatctccatgcagctcccacgaattcaggagagtcctgaggtacagcaatgaagaagcatcttggagtgctgatttgctgtggatggtgtgtgcagaacatatacaagtatgaacacatagaagaaaacagtacatcagcaataagtaagagtgctgtggaatacatatagagaagaataaggggggttgaaaatgtggagatgaagacgggtagtttccagcattaaacaagcaggcctcaatgaaaaggtgagctttgaaccaaggtttgaaggagatatgggctggctgctgtgataggaagaaaaatccccttcccctcaatgtctacatcctactcccagaagtgtgaatatgttatgttacatgacaagggggaattaagattgtagaattaaagctgctaatcagctcaccttgagaaagggagattatccttggttactgaggtgggcctaaggtaattacaaggttccttataagtgaaagaggaaggtgagactgtcagggtgatgaagcatgagaagaaatcgaaaggacattgctggctttaaatggggccaccagccaaggaatataagcagcctctaggagctgcaaaaggcaaggaaacaatctctcataaagactctgggaggaatgcagccctgccaacactttaatcttagcccactgagaaccactttggacttctgatgttcttcggaattttaagacaataaatcttgtattgttttaagccagtaaatttaaagtaatttgttagaggtctaacaggaagtaaagacagcccccatggagatatctagaagaaaagattctaggcagagacctgccagtgcaaagcttgtctgctgtgcagaatgacaaggagataacagggagagtaggaggagatgagtctaagaggtaatgaggccggaacacatagggccttgaaggccaccataacaaaaaaggaaactataaaaggttttcagcaaaagagtagcatgtggctactgtgaaaataaattgtgtgtgggtgtgcaggaagactcagtgagtttggaaacagaccagtcaagaagcaactgcagcaattcaggtgcaggatgacagtgactcccaccagggtgaagttggggagaagtcatcagattctggatatacccagaagaaaacacattattaaggtgctacattttaattacatcagtacactgttgaaatccattgtcaaaaaactggtttagatactaactgctcacattcctacaaaccaccaaaacatttactatgctctggacactaagaacacaagatgaataagcaaaggaagagattttatggacagttgtgccttaaaagaaaataaggatatatatataaatctatatatagatatatataggaaacccaacatacaaaaattttgactttataaatattaaatccagagttattcactttatggttggatattcactattcactttatatttgctactaaatgaatccactgccagcttcttaaagaatcaactgattcatttaggagcaaatataaaatcacaaatcagtagcttaaaacatgcaactactactaaacatagtatatcagaaaattgatttgtaatctatgtgagcccccttaaaactttcagaattcaaagtaaaatagctcaaagctctccccaaaagtttaaaaacaaagtggatgaagattagattaagtcacattttgtaaaatgggagtaaactttaaaatctgtatttttcaacagggtcatttatatacctctacaatagtaaaggttaagccatgagataactctgtcttggttataggctggaatacactaaatcattaccttctggtgatgaatcattccaaccccattctttcattccaacctaagtggacccaattaatttccatgccattatttggcaatagaatctaaaaagggatatgagtacaacaagaataaaatcaactactccctcagttttgtggcagaggttttgtttggtataggcagattaatctgaattgctaaattaagacagttaacatagtaatcaacacagaaattggattaacttcacattcttctacaaaagtcacagctatcaggaaccccctcagggtagtacaaattgtgaaaggctgattggaaatcctcaaattaatcccagtagttgagtgttttcattaggtaggttaaaaacatagctcctctgttggatacagacactaaaatactctgtcatgtacaaactccaaagcagaaagaatgactaatcttaaagggaaaataaaagacaaggaaggtttatggacaaaaataatgttttttaactcacaaatgttataaaggccacaacactcctcctggccagtgaggttaacattttatttttcactgttatttagcaggacttagagatagaaaaccaaatgctacactgtttaacctcaagcagcttacaccaaaaaaaaaaaaaaaaaaaaaaaggcatctaaaatgtcaaccaacaagatttatttccttagtaacattaggaggctacaaataaagggatgccatcccagggcacataaatatcttagaattcattgatgtattgtggagagcaaaacaaggagtctaaaaaccttgatcaatacagacagcttccttctgctctgaactgtggatcatctcaattactggtattcacctatgaaatgtgtttttcttttctgttgatgtgtaacgtcctgagattcccaagacatgtatacttgtgatttagagacacaactatgttttatttactatggaaatttgaggcatcttaaaaaaacaagattcacaccctaagatagtaactttatttcctttggtccacctctgcctcttgctcccccaaagacagctttctttaaaaaccgacatcccagctagaacaaaacacacctaggtacatctgtgactttttatggtaattaagttcctggttatttactacatttcaagaaaaaaaagtgggggagggggagaatttacattcaatgcaagtgttatttttattcagtgattccaaagtgaggaaagggttgctaagggcgagaagtatctcaaggaaatgtcttgttaatctgctacataagaatgtatataagagttaataatgtttttcaaaaaagttaatgctagacactatagaacaggtaaggcccttcttagcctcagaccttatccacttatatccacatcaggcacatacacccaatttcgaacaaccccctaacagagaaaggggtcaatatgcttagattgatgacctcaccatctcacccagcatagagcttcctcttactcctacttttgtcagacttcccgctttgcaagttgtcttagtatcattcaagtaaagcacatttgaaacgaacgcttaaggatctcaaaaagtaggtggggcaagtacccccatgttacagatgaaaaatgaagcaagtgtatgagcatatatgtatatgtataacctgtatatacattatacacacatattcccaagtgttgatgagaaacatctatcccccacaggctgaagaggagaagggagcacatacgcaattacaggctacattttaacaggaaattattcttaagactcaaatcacaaaagcattagcctttgaattatttccactctaggaaggaaaagagcaggtaaaggggtctgttctctttaaaagctttaattacatatacatattttgtctgataatgtcaaagcactttacaaactctaaggtgccaagtgaacagagggtattatcattattgctggacaaaacaagatgtctcttaaaatgttagcatagaaaatttgcttatctgggcctggcgcagtggctcacacttctaatccctgcactttgggaggccgaggcgggcagatcacgaggtcaggatatcgagaccaccctggctaacacggtgaaaccccatctctattaaaaatacaaaaaattagccggacttggtggcgggcgcctgtagtcccagctacacgggaggctgaggcaggacaatggcatgaacccaggaggcagagcttgcagtgagtctagatcgcaccactgcaccccaagcctgggcaaaagtgcgagagactccatctcaaaaaaaaaaaaaaaaaaaaaaaaagaaagaaagaaagaaagaaaatttgcttatctgtcttttggattaagcctgtcagtttttcttccccccacatctaaatggacagcaaggctgcagagtcgtgttgggagccttttaacatggaaaggaaagactgtggacagaaagtacagtatgcagacttttcctaatcatgactgttaattcctgtcctggactgctgaagcagatgctatgttaaactacatttagcacagtcacaaacggtgactaaggaagttaaaaatttttacttgcaatgctgcaatttttaaccccagacctccaaagactatgtttaaatatacagagtactaacagcccaagtacttcacattagaattacagccttgcctattttaatttaccttatttttaaaagtgtgtgacccccacccccctccccaactccccataaaaatacacatctcccatcctctttgagcctgcttatgctcaggctcttggaattttaataagattagaaattgctacctccttattctggctaagaactccaaagatgatccaggcatcttgtacttatattcagatttacaatacagagaaaacaagagtgtagaaatctaatccacgattataccctagaatctagattaataatgtgtacattatgagatcacatgggatcaagtttccacaattaatggatcaggcaaatgatccatgtatctacattcatacaaaatcatacactctcctatcatctttctcctatcatgatcttcaaaaatgacctgaatttaaactgtggctttaaaatcacatttaattacaagaaaaatagaaaaggaactttccgtgggatttgagtatcttttgctacagtaaagaagttcagatgatctccctgccttctggagaatccaacgaatcctacaactaaaagtaaaaataaatggcaagggaaagaaactagcaattattgattcctctttccatgccagtctcaagctagatatttacaaacaaaatcttatttaatcctcttgtggagcgggcaaggtgactcacgcttgtaattccaacactttggaaggctggaggacaccactgcactccagcttgggtggcagagcaagaccatgtctccaaaacaaatcttatgcactataagctatattacattctcttcaatttacaaatgagaatttcaaaacttcaagagttcacacaagtattaagtgagaaactgggatttgaaatcagtgctgagaccccatctagagcttcctagctgatctctctatttccaggcttgcccctttctccaatccttcctccattccacggctgtggggatctaactaaaataatgggcagcactccactactatctcttttaaagctctgctcactccacgttgcctatgaagtaacatctcagctccctagtgaggcagctgacttgaccgagctcctacctcttcatccacatgcccagcacccccgcatcatatacacaagctctaacaagctcccagtagttcttcccactcccagtgttttccagtgtcacccaacctgttttctccacctgcaacagcctacctttcttctcctgcctcatggaaacatcctcagcaccggaagagagcagacaaacctcgaggaagccttctgtgaaccactcagttggaccagataactctgtgtgctcctatatgcctgactcacctttatctccccagtaaaaaatatcaagacagatccataaagagaatgaatgccatgaattgtgattcaaggtggcaagtaaaaaacaacccccttacttatccatgtggttttatgttccctgccaagtgggaaaaatttccattgcaaccctgtatagctggaggagcagccaaagtcatctcaggttgtttataaagaggaaggtagactgtcaaggggaaaaaggggaaagtaggctgtcaagtcctaccactaacacacacatctctttccgcatatagctactaattccatattgtaagctcaaacttcaagtggaatcagcattttttaattcctagctacaagcctttgttaaaacaatataaacctcagggaggaaccagggacaggtgtgttccattgtcaccatctcacagttcaaaataagccaatctcatcaccaatgtgtaaaatcaagaggaaacctgaagtttatactctctccccaacacagccaaggtctggtgtgtagaataccaaaaagaggagtaaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctacctgacctatgctaaatagtttgctatcaaaaaaaaaaaaaaaaaaaaaaagatggcaaaatcactgctgctatggaaactaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtacccatttcctgttacaacttcatcctatgtaaagtacaagtttctttaaaagaactctcagtagagtagatttaacatgtaaattgcttagcagtaaatagtctttaactgttgataaaactttcaggaagtacctactaagtaccaggcaatatagtctacagcagttaggactgcaatctctttcagatcgagctaaaaagaaattctcgctatcatccactactttaatctgagatgggtatgaacaaaaagatccttaaaccactcttctaaagggaaccatgaccctgaacccaaatttttcaattcttctgtgaagagtgtagatctactcaaatgccactctatcgctctatcttagactattttaaagagttccttgacgattctgagtgccagtctctagttgagaatcactataagggaaatagatggtttagaaacgtgccctttctatacccttctgccccacccaagcatgctttttacatccatcctttgtcaggctaaaacccaggattcacaacaaagatctggagactgcaggccttggaattgagttgagtcatcaggacactattctttattctccatttctaaagagcaaaagtgggaaacggggggtatcatgaggtagaagcaagaacggtaaattaaaactgaagaaaacttccactgcactggaacagtaattagaccaaatttgcctgccatcaattaaggaagaacaactgctctgcatcgctggctaccaagacagcagttagttctcttaagtaacttcttgctctaactggaaaatgacccatacttttacttgccaagaataaagacagctggcctcctacattacaaataaccaaaatggaaacaagtgaatcttttttatccaccaaggttgactacacattaactaagacctattctaataaacatggccaacataaacagcagcagccaggtggcctactctgaacattcttcctgatacaaagtacatcatatacctaagggcatggtgaacaaaaccccccagagtggctatgaccagcaggaagaaaacattgaggggatgggagtcaaaagtctacttaaagtattaagcattcaaataaatggcagaatccgagggccagcttgcaaaaacaaaaaataaaaagccaacaatggactctgcttaaataaatcacgtgcgaggttgaaaagaaggacaaaggaaaagtggcaagggatagacaaaaacaagcagattctgtaactctcctcaacctccaggccaaagttcggactggcagctagcgggtagatttagcctgaaaacatgttacgtggtttctccaacgtccttaaaaacaaaacaaaacacaaacaaaaacagtagtgttcaacatttaaaatttcaccaatgtaacaatttcacattcataaaactatatttctgatttcgcttaataaataaagtttggcaagagtccatattcccagagctactagccagcaggttgccctataaatggggtgccttctttccagctctcccaatacagccttaatgttccggcccctgcaagggctggattttaagtaaaagagtatcatagcctaaatgtcaaatgtgctaaagagtatatgcttttctaccatgatggagaggttcagaatgtcagagtactgggggagggagggggttttccaaggtcatctaaactgaggatctttaattgtagacctaatcatctgtgaaaatattctaatgaatatgcataacaaaaaatgaggcaaaaaagcatcaagtctgtgtcactaaacatcctaatatgactgccacagacattcaaagcactctaaataactcattttggcctgtttatactactatggatttggattagaaagtcatcctgtccacaaagaattaggtatatcctgtcccttctgggggctgagtttgagacagttaattcaaacctaatcaaatattttgctatgagaaagaagaggaggggccaatgaagtgctttatccccaggatgaggcagtgagtagggcagcacacaaaaaagataaaaatcacctggcactacaccagaagcccttgaattaacattaaatttccaggttaacgctctaaaaactgtctcatgacaaaccacaaattgtattttggaggtaaaacaggaggtaagtggggaaggaactgaagggtaaataagaggtcttacttcacactttttctgctgcttttggtttaccccagtagaatcccatgaaaacctgcttcacactggcaaagtgggcagacagaggaacaaaggcaattccagggcctgcagaaagtcttcaaaggcaagggaagaaagcaacgccctgcctaaacactggctatttatagcacagcaatggaagatctgggaggtggctgagggaatatgaaagctagagagtgggtgggcgggcttccttctggcttccttagactcagaaactaatgcattcttccctgcctccaaagctgctattttgtttcctgtgtaaggtttcaaaatactgcaacactgtccctaggtgcatttgacaatatcagagcaattacagtttggttaaaatctgaaggtaatcaactcaccattctttgctattctctagaaaaagaggcctgaacaaagaggaggagacaccaccatccaattcataaggatggtctcccaaaatcccctgaactttcacagcgcggaaagtttctgtgatttcaagcagagaccaggagaaactatacttttcacctcttctcattaactaaaagccacagctaaaaataaaaagctggagcaattccaaaactgtgggttttatagggcacattaaattattccttatcaactgcaaacctttaaggttgcagagtattatgttaatgctattggctttttcttttttttccccagaatcggtgatagtgttccttaaaaaaaaaaaaaaaaaaaaaaaaaaaaaaaaaaaaaaaaaaaaaaaaaaaaaaacttcatgaacttccaagtccaatctctattgcaaagtaaagtatgggttcctaaatctgcagagaatatcatctattctacaaaacctcacacataacttaggttgattctcttttccaggactgtattataaaacattttgaactgagaacagatcaacagttggtattaatagtaaattataataatcattttacacttgtttcctaatctcatgcatgagattcaaaaataagaaagcagtctaacaacagagaattttctaaacagaatgtgaagctctcacatttattcaaatataaacactaaaaagtgtttagggttccccctggacattcaattgttattaactcttaagataaatttccaacttaataaacttggaaaatggctttttaagcatattttcaatttgttgaaagtttataatattgaatcctatgagtctttttataattattttcttagaaaatttgtggtcaatttcctgtgaccttcgtaaaacttaaacacacctcttagctcacatccataactatgttggcttataccaacattcttcttatattcttcattaatggtcaaggttaaagaaataagagtatttggtctaaactcaaatcaaatgatcatgtgtaacacacagcagcacccaaaacataagcactattttccataactaaaacatcagaacctaaggcatccatttataccaaaatgaagattttagttcagctcttcaggagagttaagacatggccaggtaaattaaggccaaaaaagggcaagtcacaacactatgtagcattcaggaaatttggagcaaatttaagctttcacataaaacagtcagggttaggagtggcctcagagaagcaattatctcattcccaagtcccaggctaacaaactaacagggatatggaaaaaaagactagaacgaaggtaaaagcctacataaagtccaaagacaatcactgctggtcctaaatctatttcttaatgattctgtgaccctcaacaagtttgttatgttcataacttccctcatctattaagaacagatttttctcactctgctagcgaacagggttattaaaagaaataagttataacaaattacagataaaagaatggcttataaaaaatttcaggcactatacaaagtagggtattgttctcaaggcactaaccttcttgagaattgttttctgctttcatgctctcctaaaaacacatctttaatttatggtaaggtcaaactgccattatcactgcaacctgagaaattcaaattaatggtcaaagatacacataaacacacacactccaggctttgctttcttctttccctcaaaaggtcatgttttcaccaaacagatcaggaattctacaatatactacgttccaagtaccaaatatttaagccaccaaaacatacagcagaatagcatatttaagaaaagtttcttttttttctttccttttttttttttttttgaagataggttctaattctgtcaccaaccaggctggagtacagtggtgtgatcacagctcactgcagcctcctgggctcaagggatcctcctacctcagcctcttgagtagctgggaccacaggtacacaccaccacaccccgctaattttttaaatctttttttgtttgttttttgagatggagtcttgctctgcaacccaggctggagtgcagtggcgggattctctgctcaccgcaaactctgcctcccgggttcacaccattctcctgcctcagcctcctgagtagccggcaaccgccaccacgcccggctaattttttgtatttttagtagagacggggtttcagcgtgttagtcaggatggtctcgatctcctgacctcgtgagccgcccgcctcggcctcccaaagtgctgggattacaggcgtgagccaccgcgcctggctaattttttaaaatcttttgtggagacgaggttttgccatgttgctcaggctggtctcaaactcctaggttcaaaggatcctcccacctcagcctctcaaagtgctagaattacaggcgtgagccaccatgcccgaccaagaagtttctttaacataaaaatgtccaagcagataaccaagtcaaaacacttttattactgaacagcagacggtgatgttttagttggcaatttaagaatcacacgctatagctattcctgaaaaattcaaaatcaaagtacatcgtaagcatttgctcagaggctagcatagtgcttaacgcagagtcttagcattctcaaaaacatgcaagaccagcctggccaacatggtgaaaccccagctctactaaaaatacaaaaattaaaaatacaaaaaattaaaaatacaaaaaaaaaaattacaggcgtgtggtagtgcacacctgtaatcccagctactcaggaggctgaggcaggagaatcacttgaatctgggaggcagaggttgcaatgagccaagatcctgccaccacactccagactgggtgacagagcaagactgtctccaaaaaacaaacaaacaaacgaaaagaaaccaaaccaaaacaaaaaaccatgcaagagcttaagccattttaaagagctgcaaccatgaactaagatttagcctgaagacaattagcgtacgttccatcccataccaagaaaaccactttatatgctcaaatacttcttggtatattctgccaatgaggcgattctacctgaatttattaataaactatttaccagcctgcttgaccaccaaggtttggtaaacagacttgggcccgatgtggaagcatagctaaggatggagaccccggggcacaagaagtgagctgaagtgaaaccaggaaggaagacaaatttctttgatagcctcttctctttccaatcccagcttcccatctcagttgctcattgtgccttcatcccctctcccatttgagagctcagctgagtctgcagatatcccaagatactaactggtaactatttggctagagtgagagcccacttcattttctatgcatccaacaaactcttatctcaaaagggcaataagcatacctggaatttactccaatacctgtgaaaggtagccaaactctactctccggaggcgtgaagtcatcatacttccagataagacattaataagcagaattatccttacctcatttgttacactttagtcctccaaattaaaaacagccaaagagaaactagcttgtaaacaaaagtaaatattcaaggtgccaagactggaagacagcaagatctcactcagctcacagtctgaagccacttaaatggagtaactccaaggaaaaccgaaagttaaactgaagaaaaacatgtaacttcagagagcatgaaaaactggtacaattctgcacaactacaaagtggccatgcactaacctgaaaacaacgaggttcattattgaataaaggcatcaggaattcttggagatggagctttcaaataaggctttagtcaccactaaaaggacacagaagaaaacagatatgcctcaaatatcaacacatttgaaggacagacatctgcattcattctaacatgcaaatcctatgtgcagggcactgtgctggataaccaagatgactcagataaggagttcccacttactgtctaagcaaagaagggaacacatgcagaaccacaacacaggacgcaatctggtaagtgtgagaaggagagattgtatctggatgacagatgaaaaaaaaaaatcaggctcagaacagagaaaagccatgtgcactaggctctctgttgtcataggttcaaataaagggcaaagtacacatagttgcaatcatttttaaaatgctgggcacaggccgggcgcggtggctcacacctgtaatcccagcactttgggaggctgaggcgcgtggatcacgaggtcaggagatcgagaccatcctggctaacacggtgaaaccccgtctctactaaaaaaaatacaaaaaaattagccgggcatggtggcgggcgcctgtaatcccagctactgaggaggctgagacaggagaatggcgtgaacctgggaggcagagcttgctgtgagccgagattgcgccacgacactccagcctggggccacagagcaagactccgtctcaaaaaacaaaaacaaaaatgctgggcacagagactatagcataaacaagacaggtactaagggaacttagtgggagagacatattaaacaagccaaagaataaagctaatgtttagaattgcagttcatgccatgaaggaaaaaaggatgctgtgggaataaaactgggacagtgatcagaagaaaagccttctgcagattaagtgacatttaagctgagatctaaagataaacatgactacatatatgtaatacttggtctttggaaggtaaaggatggtgccacacacatactaggtagtgttgggggcagtgggactggtgaataagacataatttgtaccctgaggaatgtcatcctagggatgcaattacatccaatatgtggaacccagcaggcagagttttacaattatggataaaacttaagctacagagatcttgaaacccatctatcctcaaccattcctttttatcaaatgaaggaaatgaaacccagaggctggctcagtgtttctgaactaggtaggtgcagaggtggggcacaacctgtaactcccattacatcacactgccaattaactttttaatcagaatttatgtggaatgtcagaattcagtaaattgatcatgtacaagaaacacttaatatccgtagggaaaaataagtagacttgggcctaaatgccaagtacttcactagacattgtgggaaaaatcttatttggttccaggcaaaataagaaatgtaatgagttttttgtaaagtgaaatatattcaatttctcttgtgaagttacgtgcatcctactttggggcatctaagcaaaccaggaaatgacagtgataatagataatgtgtcagatggtcttaaatgcctttccttggcaaaacagagttgacaaacctattattcccctcccacaatgtacagttttacttcttattgtacttccctgagaagtacatatatcaaggaacaactgtcacaatgagggttgaggcagtagagggagccactcccagagttcacagcagcactgttcatcaaagcacaagaaatgaaaacaaagtgtttatcaaggaagatgaacaagaaagatatgaagataaagtcatacaagttcacacaattcaatgttcttcagcagccaagtaagagcccacacatagaccaaagcatattataaaatgagaattttgatgaatttaacttagtgtcctggaggacaaaaaaggacttaggatcttttagttatcacagctgcacctacaagtcaaatataggcaaaatgaaacatttttaatcagatatctcccaaattttgcattactttaaggatagtgtgaaaacaaaaataacaagggaggaaacaatccccttcaaattgaagccactatagctcaatcctcactgtctcacgtctgttaacccaaaactcccagtatgagtacgaatcagtcacgacatagaaatctagacctattctgtcaatgagcagctgctccaggtctgcatcaatctgtaaacaggtatttccaaagcatatgaccagctccagtctgagcagaataacagatcaaaactggagaggacacacaatgggaaaagtagttgatcggtttgatagaggaagagacactgggtcccactcaaaaataaagtatctcaactttttcactgaatttacattcccaaagaatagattgtaaaataagtaagaatcccagacttttcggtacttgaaggtcactatgaggtcacctggcatagtgatctactgcaagaacagcctgactggtcttcactgatgctacattctattttgtactctgtctcaagctagctgaacttgagagacttctaagtctatccaaggacatttgaaacatttgtgataaatgcagagtatttatctctgttaacaatgaagaaaagtcaccttccagaagaattgctgtgaaagcccacatcgtgtgcactattttttaaaaagtaacatagaaaagctgtttaacataccaggaaagtcaaggagaactttaaaaaaattataaccataatacctaatttcatcaaaatgatgtaagcaacaaagatctaatttatattgagataaactatataggctcagactattcaggcaaggaaccagtaaatgcttatttcatactgaaatttacaggacatgaatgacttagcaatatatattgaccctgagctactgaaatgacaacaacccaaaggtgattactgacatatcagaagaataacaatgaaacttgagggcgagagtctctttcacactttaaaaaaaaaatgcagctcaataaaaatgtacctattaaaaatagaaagacagttatccctttcaactggtgttgatctgccctttattactggagatagactgtatcactcagaaagttaccctgaagctataagaagcttggaggaaaatattaaacttcaaggtacagataggaccaggagcctgttaagacagaaaacgaagacattaatgttcaaaaagtatataagcaggaaacctgcagtagtctcagtaacagattttagtggcaaaaaaaaaaaaaaaaaaaaaagagagagagagaaaggaaagccttttaaaaatctaagccactggaattttaaagtgacacccacatgacccagtttacttttctattcaaagaagttctgatgctgtttctctatttctctttggaagtttttcatgtccaatatattgcaaaagataaaaggtacacttttatttaagcacacaatggaataaaacatcactgaggaacttggacctgtaaataaattttaatgggaaagacaagaattcaaacatgaggaaagggcaacagatatatatacggcaaatgtgagaaagaatatgagcatttggaaaaggaagacaacattgttggacagggtaggatgacagctattaatttaatttaggatatgctaggccatgctctaagccgttttaaagggcattacccccctgtgatcctaataacttaataaaatgggtcatttcatccccattttttttttttttgagacggagtttcgctcttgtctcccaggctggagtgcaatggcatgatcttagctcactgcaaactgcctcagcctccagagtagctaggattacaggcacccgccaccatgcccagctaatttttctatttttaatagagatgggtttccaccatgttggccaggctggtctcgaactcctaacctcaggtgatccaaccgcctcagcctcctaaagtgctgggattacaggcatgagccaccacgcctggcctcatccctatttttcaaatgaggaaataggcttaaaaaaacaaaaaaaaaagattaacttttccagaactcacaaaacctgccaatgtgggtctaacaaactccagagcccatgctctttgcaccacacatcaatgaagcagctaaaataaccaatatcttgcttcaccccagaccaattaaataagaatctctcctaagggcccagatactggcatttttatcagcacccgatttgattctaatctgcaagcaaggatgagaaccactgtaaaagacttttgtaagacaagtggactatcagctaggtagtgccaaacaaacaagagtcaaataatcagagactggggaattcatccagcttttagagggcaaacagaagttcaaaaacagtggaggtgctgaggcagagctgatccagactaacttcagggaaagtctgaacacaggctttagtccaagcagtgattaaaaaggcgcaaaaaaccaggttggaatcattttgctgagagaatgaactacaggttagaaaatttttacttttaagactgtaggtaagaagggagcacaaaatgacttttacagctaatgtaaccaatgggtatgaattttaggaaaataaggaaaaaataacagttgactaacctaaagccaatggaccaggatataaaatataacaagtgagtgacaataaacagagcttgctgagcaatcggatatagcctagtagttacaactgttaactctacggtgatcccttctagcatttgccatcctaagtcttgatttcctcatttaggaaatggagaaaataatcctatcatctcattcagttattggaataaatatatgagatatggcagtcccctttttaccaggcactcaaaagccccaatagatgcctgaaacttcagatagaactgacccctaccatgttttttcctacacatacctatgataaaatttaatttctaaactgggcccagtaagacattaacaataactaagaactgctgtaacagtacactgtaataaaagttatgtatatgtgatctctcagcgtatttagttttctttaagtcgagaactttcacctttttacttaaagggaacatggagcactttaacatcctctctttggcatgtcagaactgccagcatcactactcttgtgctttggggccgctgaaagtaaaagaagggctacttgaacacgagcagtgcaatacctcgaaagtcaatcttataactgagatggctatactaagggactaacagcatggatacactagacaaagggaggattcacatcctgactggtcagcatgagggtacatcacactattcagaagtacacgcagtgtaaaacttgtgaattgtttatgcctggaattttccatttaatatttgtgaaccacagttgactgcaggtaacggaaatcatggaaagcgaaactgtgggtaaggaggaactactgccatccaagcaaaagaaaagagaccaacggcttctgtattcttatagagggcagtgtaagaatatagtcccccaattttttccttcttaccattacaactttagatggccttgttaaagactcagtaaatggggaatagaagtttggcctgcttattcagttcctattagtccctatatagagggactgcttattcagtccctatacagagggtcagtgaccctctatatcagtctaggccagtgcccagacactagacgcagccacaagaaatgcaagttttcctaaatggtaaggtggaatgtatgtcccctaaccctactgaagtgaccgtcatttcacaaatagtgaatttatatattaagtgatttattaaatttatgctacatacaaaattacgtattaaaatgcatatgtgtcctcaactgaattcttgaggcatagtattgaggaaacagttcaaaatagtaatacaattcggtaaaacttttaattatttctcaaaagaatccacacaacttaaaatctgacacctgctgaatgataaagcttggtcatctgcacaacttcctattcaactttcattttcacaaaccttattttgtcttaagatgatttccacgcactcagcagggtaatcttttagctaaatgatccgaaacccacaatctgaatggcaagaaattgcttcctaaataatgtatcgtattatacaagctatcacatatctcccttccccagaaaagtaaataaacattcttaaagacagcccagaggaaaacagtatggttgcaaaacagttagcttcttatatctttcaagactttactaaatgtcacttataaatgagaaaacatatttgaagtttttaagtgttctatgctttttaaaccctttcctgaatgtatacaggtaggacactcagaggtaaggtaaggggtaaccatgttcctaaattacattaatttctaatgcctgaaaccaaagttttcaaagggctataaatgcttgaataatccattaagatacacaaaatgacaggttgatggtaaaaaaggggaaaaaaaaaaaacaacctttcaacaaatgacaaattttctcctaaatcattctttggttagaggaccaatgtaaaagaggcaggtccgagtgctgttttgtactggaaacaaaacagatgtaacaggtgtaatgaataccagagagagatgagacagaaaatcttgaaattaaacttctgtggtagaaaaaaagagagggaatacaaaaatatatggaaatgcctggttggatgaaaggagagtagatattctaaccaaaccatttaaatccacattattagacaccccaatacccgctttcccagtctgtgactgcacaggtaaagccaaaatatattttctgctttggaatagattttctacttaggattagttacaggcatatcggctgctctgggaattcactttcaaatataatgaggccacactaaaaacttgaaggaagtgaaatagtatccttcatctcatctgtcaccataaagctcaacgtaaagaaagctaaaaggctcactgcagtccctcaagaaaaagttaaaggtttgactctctgctgattaccttgaatagacagccaaattaggctggagcaaataactataaactgactatctaatgtaactaggcattagccattcatcccagagctttaattttatgttttatatattacggttcccctggtgattttccgcatacctcattaagttctgacttgaggatgtctgctctggacgagcacacagagcaacacaacacaaaacatcctaaacctcacatctcttagtatttccaacacaaacatcgcaggtctcctgatgaacacttaacctctacatgttctctaagtacagagtgcctagagtctcagagctgcacagacaccagcagacattctgtgaaaacactgccaagaccctcttgacatctgtggcaaaaacatcctgtcttctaaatatatgttctgtttaagtggcttttaaagcataagcatggtgcctttaaaagcagtttgtaacaagaggtcaaactataaaactgaagaggttagagaagaaatcaattgtatatcaattgtcaaaactcaactttaaaaggcagaggtggtcacaaactactgtacagacagggtaaatggaaaagaaatctccaggttgaaaacggcaaatgctaatcgcaggggtgggagcaaggagtcttgaccaatcgtaaagatgagaaagcatttcccttctggaatgaaaaactaaaactgtagatcagaaattcaggggaaaagaatcatttctgttcatgcctcgagaaattaaatacccttacccctgttagagaactgaagtgtatctcccaaaattaacatgttgaaaccataatctccaacgtgactatatttgaaaacagggttgtgtagttcagtagtttcagtagaaacggtacttcaagtaactacacaaccactctgtttttcactctatttccttaattatttcaggaaataaggctaaatgaggtcataagtgtaaataattaagaataaatgaggtcacaagtatggggccctaatccaataggattggtgtccatataagaaaaggaagagacaccaatgatttctccttctttacatacccagagtaaaagctaagtgaggacacagtgagaaggtggccttctgcaagcctgaaacagtggtcttgccagaaaccaacactaccaaaaccttgatcttggtcttccagcctccagaaccatgagaaaataaatttctattgtttttgctacccaggctatggtattctgttatggcagcctaagcaaactaatacaacccccacaccaattcttaatctctcagttgtcttttcctctcattgctgccacccaatcttttcctggaatctgaaccttaggtatgcaaatagtccccaacttacatggtttgacttaacagtttctaaactttgtaatggtgcaagatcgatacacattcagtagaaacagcacttcaagtaactacaccatcattctatttttcactgtcagtattcagtaaattacatgaaacattcaacacttttattataaaacaggctttgtgttagatggttttgcccaattataggctaatgcaagtgttctaagcagatttaaggcaggctaggcgaaagctatgatgttaagcaggttaagtatgttaaatgtattttctacttatgacatcttcaacttaacttaaagatgggtttatcaggacataagccccatcataagtcagagcaccttcttgtagccactgaaccatgccccctcgcttttgaatcaacactgtcatctatccataactgctaatttaccttcactaaaatgagtgtctaccaatatctacccctcatcctccaattcccatgagaccagggcaagcctttatcatcatatacactgcttcaaatctgtctcctcctccaacatgctcatctttatataatggctagcttcaacttcccaaaaacatctcatgctatcacttgctcaaataccatcaattgtatacatacagaccttcatttaagggcctttttaactttctaatccatccctaatgttttctcccaacttctcaagccaaaaccctgcataaggtcaaaatgacccataaccatcctctgaatctgttgcattattttatttacttccttttttcatatttttcttttattttttagacacaagttcttactctgtcgcccaggatggagtacagcggtgtggtcacagctcacggtggcctccaactcctagaatcatgctatcctcccccgtcggccttccaagtatctgggactacaggcatgcatcaccacacccagttattttttattttttactttttgtagacacagggtcctcactatgttgttgagactggtcttgaactcctggcctcaagcaatccctccccgcaaggcctcccaaagtgctgggattacaggagtgaggcaccactgcctggcctgtttccttgcttttattcctattgttgtgacaatttggaatgtcctctctgcttatttcctttctaaatggcagctggaagaaagaagttctgaagaacattacacaatcacaaggggcttgttatggcaaaaccttctaccctcaactgctgctctgccacatactgattttattcaaataggcttttacctccaccaaatcatgccaggtacttacacaatatctgaaagatggtaccaatttcagctccacataaatagaaaatgggaagatctgacacaaatgaaattcagagttttcagaggctctcatctccccctaagtattatcatcctaagtaaggtctagagaccatgagacacacatatagatttgatctgagctcaatcagttcttctctcaaaccctcaactttttttctaaagctatcacctaaatcccagcaacaaaactaatagagtctctcagattttcccaattttcaacgatcccctcccctatcattcctccaaagaacatcataacaagcctcttcaacactctctttatgagagcctgagcttcgtaacctatactggatccttattgattttcatcatgtgagtgacaaaacacagtaatatactaagatttccaacaacctgaatacctggctcttgatttttacatgcccccaaaatagcctctgtcccactcagtggactttccacctccaaacttttataactattttctccactcatgatcttctccctactggttccaatttacacgcatgctcttcattataagctttgctgatcttctctaataaattttgcttacccctttaaaaacagtcctccaagagctctttcctggtaacttagcatgcactatatcatacagccatttgtaaggccccatcaatgactccacctgtatgtggtcatctttatatagaaacccaaccagaatggagacataaaattctagaagagctttagttctttcatcattgtgatctaaatcaaagggcactgcagtcagcagcacccagagatactccaatgtcactgactagcataccaacagcattcaagctgcttcatgagcttatctttccccttctaacttcagggttggtagggcaaagaaatgacaccaatgacatctacaatcagggcctggaatcaaaagcaaactgatagtgtaacattcagggacttcagtgacactttcctagaacactgagtgcccaaaagggctgggccatcagcttcccctaaagaggggaaaagaaccacccactttctacaacagattgactgttaaacacacgtacagcaggcctcttgcaggagaaaaggcaagctgtcctgccagagttcctaaaagcttctgaggacaacaatttttcttagggagtgaaaatatataccctaatccatactggatagacagcccccatttttcaaattcaaggctgaataagatacattcagttttaaacattcctagaatttgagaattccaaagtatcaaccatttttacatcaaataactacattagtcaaaccagactaattattaaaattacacaaagcttgtacaaatcaatccttaatgtttaggaaaatcatgaaaaaatttgtgtggggaaaccagtctaatcttttcagatccagtacaccaaccacttggcaatgctccctacaatctgggaagatttcctgaccaatggaatacagataaaatatggcagagtatgcattaatccttccatcttctcttgttttaataataagtagagagccaggaccatacaaattaggtatatacagctcctagaaaaataaaatttaactaaagctaaagaagatgaacacttctttaaccaaatttcccaccttattttatcttatgcacacctacaaaacatctgtatacatgccttataatagcttttgatcaactgctatcaaaacaaactaaaggagtaaaataatattactgctcttcagacattaaaaaacacatttctaagcaatattttcaaagtcaacaactttgaaaaattaagtccttatctttatagaccacaggctcattataattaagtgggtagtttgtttatattttatataagattccctaagaacctaagatcctgccagtgtctatttaagaaatggagaaaatgttgggcgtggtggctcatgcctgtaatcccagcactttgggaggctgaggtgggtgggtcacctgaggtcaggagttcgagaacagcgtggccaacatggtaaaatcccatctctactaaaaatacaaaattagcttcgtgtggtggtacatggctgtagtcccagctactcgcgaggctgtgacaggagaatcgcttgaacctgggaggcggaggctgcagtgagccgagatcacgccactgctgtccagcctgagcgagacagagcaagactccatctcaaaaaaataaaaataaaaaataaatggggaaaacaacattgtaagtactggaaaatactacgtccatagtcattgatatataaaatgtctcaaaaaataggactgtcataaaatacagaacctcttacagagaagaaattttaagttgccactattaaaatggaatttaaaatctcaagattccacatatttaagaacgaatattcctttgttcatcacaaagctgagacaaaaacaagacatttaatggcaatgtgtctcctccctgaaagttgattttattgctatttagcatttccaggaaataatttctaagagctaaacaatcatttttaatattgactcctcttcacagcccgctctgcagcaccaccaccttcttacaaaccgggggaaaaatgcataagtggatgtttaaattactttcttgatcaatattgtttcccaccagattttggaatattatgaaaacgaagtgtacccattttggtccttggaccttcaattgtttcttaatttttatgagaaacaaaaatttgaacagtaatatacttctgcaatccaaagaagaattaaaccaaaagacaaatgatgaactttctaggtcctactataaaacactagagttagaagggtgatcattgttaacatacaactctggttcaagccctggttatggggctttcactgggttattacagttcttgttatttacaaatgtggaagcttattacatataaaagctcttacttctaataacctttgggtaacttgcaatctccatttaaaaagcctcttcctcacaattactgtccatttgaagagcgatttgacccatactctgtcctttgagacatcacataaaaggactctcacctactcaaaaatcaatcttttcagtcagatgaaatcttaatgaaagctgagatcatctcgaggaaagcaaaatactgccaaaaggcaaaaacagcttcacactctaacggtaaacccacaaaattgccagattaaaattctgctgcttagtcattatgatccaaagatgcatgacttgcctcactagggcaatggctgtctataagtaagatatctagagtttacaccatccttacggagagccttgacactattattgccaaatctatacgtagagttagttccctgcacaagaagatatttaattatagctctataattttttttcaaaacagagtaatatcccaaatatgtaaaagatatcctgagaacaattgcccttgcccttcgtcctttgtataggttattctactgattcaatatcagtcatggaatatactagagaaaatagattctgacttgcttatctcttcattttaaccccattttcctcattccaaatagtaaggatgcatttgagagatagctaactataaagaatgaggacagggacaatggactgcaaagctggttgatgcagagtccaactcacaagcatgacatggtagccaatttagctaaatggacacaggttgaattaacctgacctttatgcttcaatgtcctaatttgtacaatagctaccatctgcccagctgagtcctgagcagctaacaacaggatttgaagagtttaagattcgagacaaaaatgaaccaaaatccagaatgaatcctactaattctacttaagcccaaaagtgaacctctatcctctgtttaaaagaaaaacacaggcgttttcaaaaaaatacaaccagtaaaggcactacaaaaacagcacggctttctaaatatcattaaactgatcttaaattgtaatgcatgctaagtccctagcacatcacaggaacagtgtaaatataaacacaaactaaatgaagaaatgtgtaagtcatcttcatgttatctggtaaatctcatgtatgatacacttcaataaaatcccaaaggccagctattgggaatttaaaacagaaagggtgcttggtagcaggaggggcatgggtggtagataatgacagaaataattaaaggtagggactgagaggagattttttaaaggacaccaggtgtacgatttaggtttgccataatgatatacttgagtgaataaaaagtatgggatgcgggcgtggtggcttacgcctgtaatcccagtactttgggaggctgaggcaggtggatcatctgaggtctggagtttgagaccaatctgaccaacatggagaaaaccccgcctctgctaaaaatacaaaattaggtgggcgtggtggcgcatgcctgtaatccgagctactcgggtggctgaggcaggagaatctcttgaacctgggaagcggaggttgcggtaagctgaaatcacgccattgcactccagcttgcgcaacaagagtgaaactctgtctcaaaagaaaaaaaaagaaaagaaaagaaaaaaaaagtatgggataagaattcatgggtcatgatcaagagaaaaagttatttggctagttcatgaagtaaacattgcatccggcaaagaagggagaactctgaatgcctgaaagtgtttgaaatctgttctgtaagcaatagggagccactgaaaccttcaggcaggatgacagagccaaagctgtcctttaactgtctcttacaagattctaactcaaatgtgcctaaattctgcaaggttatttatctgaggagacagttcataatattagtgcaaaaaggtcgcaacagcaaaacaggaccctttatttgattaaataatttagttctaacacctgggcagagagaattccagtatagatgttactgtgcactctgaagccagactgcgtgagttctaattccagctctgtcatttactgcatctttgggcctgtaacttaaatcactctacgtgccatttccttacctataaaatggcgggggtggggagataattataccacctacatctcagagttttgtaagaactcaagtgagtgaatccatgtagactgctgagaacagtgcctggcacagagaagcagccttcaaattatgctgacacaaccacttctatgccataccctttgacatctgataaatgttactgtaacatttcatataaagtatcagaatatggattctgcctttgtagggggtgtgtgtgggaagggagacgagggaggagtcagatttttctgttcctatccttcaaaaccacaagctaaaagctatacacctaggtgaacactttccatttccaataggccttgtccatttttcccttctcgatggtttaaaatggttcccaggcacacgtgtaattaaattcattatcttaaaaaactgcttcaggaaatgcagcaatcaaatctgccaccatctgttttttatagatagatataattacaacctaataggcatcatttaatcaagacttaacaattaggttcttaaatccaaaacttgatcattttcttccttgatatgtgtacaaaattttctcccaggtggtggtcatgtaaagtgaaggatggaagaactattaaaacccttatcataatggccttcctaaagtgctaattattacacaattaagacagacataatatgactagaaagcctaagaaaatctaatgcaatctcacagaagctttttaaaatttttttccatctctatctccaaactacctaccaaaaaacccaaaatacaaaggagtacctctcgcctatgacttcttaacaagcgaagtcaggagtagcaccaaaccttcccctggttctaacatcacctagtcagatctttagaggagaaaagcaatcctatctgttaccttgtttcccatcccgcattttaagagataagaaacccaggacctgaaaagtgagtattttcctaaggcactcagggtgaaacctggactagaacctagatgtccctccataaaaaacaagattttgtactcttactccaccccaccacgtgagtggggaaaagcagagttttgagggcctacaatcctcaagtctgatcactgggtctctcacatctaattacaatatccagccccatttccaacttaataagattaattctttgtcactgatgctcaatagtaactcttgctactcccagcagccaacaccctagtttgaaagacatgcaggtcaccagtgcatcttctattgagagcccctaattgccttaccacacccaaggtgcttcctgctagactaagcttctttacagacctaacacaccaaataagagaccacagttgggcaagaaatctattaagaattagaaaaccctgaaagggctctatttaccactgaaaagaaaaatcttaagccctttgtagtttcccattctctttcctttcccaaaagctttaagaggtctcccagcaaacctaaaccaagccctcacttttaaacacagctgtccaaggactctgtgggtgggtgcaggggacagacctaatctttccctatgcaagatttgaagagtattagagaaacaaagcattaaagaaacaaaagccttaaagtccaatatttctcctaaaataacctcattaaggcaagttttctttggtcttccaaagaatcccaattcaaaaatgagaaaagaaagtagctaataatgagggcttcaccataaagcatcacaatcaacctttcattattcccattctgtaggtcagacatcgaaggcttggataggtggagtgactttgaatagggaccccaaattctgaactggaggtgtaacaatcaagtcctaaaacagtagagttcctattcctcttctcagcttattttaacaccaaatgtgtaacccagggtatctgctcatgcaggggcctaagtgcacccttcacaacccgggatggtagtgcccaagagcagctctactaagccagaatgagcaaatggcaccatgcttacatgaggagaaggacctcacaagctgcagaacatgtccagcctagcccccttccctcttattcaaggatgaagtgaaatgcactacagccctatatgcttaagatatcagatggaaattttaagaattctttcaaagaacataggtcattatccccaactttggaaaactacttcagattacttggttttggggagtagagaatcagtatagaatgcttctcaagcaaatgaatctacaaaattagaaaatttgacttacttaaaataacttacagtaaaagtttaaaactaaactttaaatttagtttgggaaaacagatgacgtatgaaattttttattcaaatacgaatttagatctatcttcatctgatacgggtgccttcaagggcaatgagccgctttttaaatctcctcagaggatcctattcacattaaacagaagccacaggaaaactggcattaacatttccttcctgcttgttggaaagcaaggcaccttatttgagggctttccagatcaagaacacattttataccaataaactttacagctgggcccagcagagatctacaaattaaggctaattgtgaactgtacagcaactgtccttcgtcttccatttttatattttatttcaatttggagctacctaacagacacagaagccctccagactatttctcaaaactttctgtttggaagtaggtacacgcacccaggaatactgaagtatgaaataaatattaagagcctagaacaaaatacaaaaacattactggaaataggctcaatatgttttaaaataacatttaaaacttaactgctgctttatttcttttaaactcaaagaaattttctcaggtagaagattttttaaagctacaagggatttcaaaatgaaaaactaatatttcttctcttgaatgttgtgcttgaaaggaaaagttatactgtcattcattcaataaatattaagctctacgtacaggagctattggaatataaagtgtgtctttgccttcaagggctactcagttttcagacaagtaaatttcttgcaagcagaaatcccagagtatcaatgatctcaccaacagaagtgtcctagctaagggactttagttttaaacagaaatcaacatcattaagaatgctagatgtcactgttactgacatttcttgatccagttagggtgtataaaggtcaacatctgacaacagaatgttcacgcattagttatccaaactaaaatgcagaaaatgtctaaatcagcacatttgaaactagaaagaaattaattctattacaatattaaatgtggaatcatacacagaaaaataaatgggcacccttcactaccaacaccccattttgcattttaaagggggaagggactcccacagagttttcttctaacaagcgctgcaaataggaattgacaggtggagccctgattgacaatggtggttttagatgacacctcacctccctcctccttacccacctaatctcacgactaatgcgggaagctgaaataaatacagtggaagattgtttatctgtttcgttttgtttttttaagtgcagatgtgttccacaattgaagaaagaggttaagattctatacacatcctgggtaccatttagtcaatgtctacttgagcaacaaactaggacaatgaaaccaatacaggaagaagaaaatgcatggagcaggtgaactactccgaggtgcatttttagctcatgtgaccttccaacgtgctccaagtatgttgtatgtagatgtgtgggcatgtatttatagaaagggtcaagagcgctataaaaaatacattaataatgttagtgctacaagggacttccaaacgctagcccacagcctcaatttttagacagagaaagcaagccccaagacttggccaaactttctagtgatagaatttgctagtgatagaatctggtcatagcattcaagttttcaactcctgaagacaatcttacctccaaagtactccaattccacagctttattcttaaatttacccctcccctagaaagatgactgcccactcctccctacaatacagattccaagttttaagactcagatgggcctagccctgccttccaagaatccattaggctaatccagtggttctcaaagcatagcctgggaacctaagagtcctctgagacttcctcatacatccgggaagtcaagagaatgccttttcctctcataaatgtacagtagagctttctaaaggttatatgtgacacttgcttctgcattcagtctgttgcaatgagaatacagttgactagatctattaagccagacgttaaagaaatgtaaaatgtaaaactatgccagccttactttttaaaaatatacatattcctcactttaaaaatattttttaatatgtaatgggtttgctatttaaacaggtttttaaactttctcatcttaatttcttatacagtaaatatttatacacataacaaacaaaaggtcctggggtcctcaataatttaagtgtacaaagggatcctctgatcaagaactttgagaattactggtctaattcactgctacataagcatgcctttatggtgaatccctttagcccatatagataaaccttagaacagcttccaactactctccttaccttcaaagggatgttcctccagctctgggactatgtaaactacttctcatgcccagtactaccctgatttataagaaaaaaacgtgaatcatctcaactgcctttaatgtaaaatttttacataaacattgtcggggaaacatgaatataactgtatattctggttctcagaaaagatgctttataaagcataacaagctattacatgtttcatgttgcatacttacactggtttagaaaaatgcttgagtatcttatgagtctctcctacacaatacaaagcatgccagaagcagtttttcactttcatttgggggtttacaccctagtcaggaagccatgcatgctccatcttcctctcaaagccctggtgcgttcctcctcaaggcccctttagccacatcagcccatgtcttttgcttcagttttcctcacactaagccatcctgtaaaattgtcccaaggctggctctctcaaacaaaataagagaaatgttcctgtatggatttcagtgtcctctagaaacccacccatgttccaataatcaaaactttttccttacatgctaggagtacaccacacttaatcctcttctcctggggggttgcgggtggggtggggggacaagtccccctatctgtataaaagagcttcacaagtgctactacatctacctggtttcaggaaccttttcccaatgtttgcagcagacctcaccaaactcccataaactcacgttttcttcctctggactgtcaaccagacttggagaacttgagagtggcatccacatcctagtgtttctgagcacccaacgaccatgcacaacgctcagctcaaggcaggcactgaatgctaacaaacagctcatatgtaggaaaagtgcaaatctattaaaatgctctgaaaagcccaagggggatcagcttttgaagtaattagtaattctattataataatttgtgcaaattaaaaaatatatatttgatgcaaaaagataaccacagaactgtttaaaagatggatttattatttatttatttatttattttttttttgagacggcgtctcgctctgtcgcccaggcaggagtgcaatggcatgatctcggctcacagcaacctccacctcctgggttcaagcaataaaagacagaaatatttaatttcttcaaatctacacctgagaggttaacaatttcatgaacactttgaacactttcaaagaaaatacaaacatgtaatggcacaggtgaggaaaagtaaatacttaatacatagatctttttgaatgctctctgaaccttgctttttacatttcaagatcagcacatactctttatttacagatactatataatagagatatataccctgattaatttaaccaatcccctactgatgaacattccaaggttttgctatttcaaacagtgcttacaatagataccttatacagtaaagcaaaaatgtaaatttaaagatagaaattgctggtttgtagtctatttgcatttttaattacgctagtcactgccaaaaaaaacttctgaaaacttatcagtttgcagtcccaccaaagcataacctacatttttaaaaaggaaataatgcagcagtgtagagagggcactgggggaagtaaaggcaagtcgggaaccagccacaaggtcacagtcaccaaccacaatcattatacctaagactttagacaatacatcttagcatcagttctgaatgtatatgaaatgagactgctgttcaacactatgggtagggcctttccagctctaacattctctgatgtccttgaacttgttatatataagaaatgtacattaaatatgaagacagaatgcttatcctcttggactacccaaggacaacaaataaatgctgggaaagtcagctgcaacactgggaacataaatgctctgacaaacccctgctaggaatttcaaaatggaagtgaaattgagactgaagaaaaagaccacctaataggaaatataaaaagccatttcaaaaatgataaacaaaagaaagacgttaatcatttggggattttcctagtttaaaacaaaccacatctccgtaaaagaaatatggctaaatggctataacaagtaagggccaaagcaccctcatggctactaataaataaaacggtacaaacatccctttcaagtctaccatttgagagagtggatactaacaagagatatgatttgctaagctaaataaaagccttcattaacaagaagtgacaggatcacaaccctgctgctgataaactgccaacatacccaaggtcttcaatgaagggttgcccatttaacatactgcagctttaaaatgagttgctttagaacgaacagttctatgtcaaggcaggcctacaacatacaaaacagatggagctgctactgtaccttgggcttgtgtgtgtacccatgcacgagcatgagcttggcatataccacaggagaacctggcccaataacgcttcttaaagttagccatccatgattagagcatctaccttagacctcaacttctctatctgcttccaaagatactcagtgtagagcagaaaacattcttctgatagccgaagagggttccacatggctattaaatgactggcccagtggtcatccatggagacccctccttattcctggcaaacacagtcatttcagtccaaccttgaagcagccaatatcttttcaatacagcacactttgaagcggtattaacaggtcataaatacatgtaaaaagcatagtttcagcttagtcaaagtggttacagaagcatcattgtatatttttttctgggtggtccaagtaaattaaactcaccaactagactgcaaacagataccataaattcttaattattcacaggtatggatgaaaagaaatagcactttaataaagtcatcttaaaatattattcagtatccagcacttaattaccatcatatagtagtgatatctaaaaaacatagaaatgtttgctatagtttaaatattaacaatttttattaactccaattggttaaatatgtaagttatacaacttcatagcaaccaaaataccaaggccgaatacacaattaaaagaaaaaaacttgcatgtaacatttaccttcagcatatataattttaatcttcattttaaagacataggacctattagattcaagaaatcagactagccaggtgaggtggctcaggtctgtaatcccagcactttggaagtccaaagcagaaggatcccttgagcccaggatttcaagacaagcctgggtaagatggtgagaccccatctctacaaaaaaatttaaaaattagccagttgcagtaaagcatgcctatagacccaactactcaggaggctgatgctggaggatccctaaaagcccaggaattcaaagttacagttaactatgatcatgccactgcagtgagactaaatctcttaaaaaaaaaaatcagtaataagacaataagacccactatattcagaaaacaaagttataagaatcactgacatcaaagagcttccaatgtagttgaaagtaacatttaagttgtgccctgaaaatttaaaccaatataaaaagctattaaggagagaccagacaccaaaggcaatgggaagttgttaccccaagtgcccattccgtaacagctccttaactctcatacctgctgtccctgtaatgccagaagtaaaattaaaattctcctctcctgaactaaaacttggtttacttctctccaaattccatcaagagtagaggttactgtctatattttcagtagcttccttctgcacctaaggaaaaggggctgaaatctaaaagctgtgatgaaataatatccacctacaaaaaaatgctatatccatgttaaatcaaacaattataaatggtataagctaaaaggcatgcaaagtttttattatcttcctaaagaccagcttatattaaaaataaaactgtttgccagagtccacctctctgaggaaactaagagcctagtcaagtaagcttaataatctaataaggtggtcagaaagacactattttaaaatatcatatccttgccatgcattcactgtactgtttaggtctggtgatctgtgtgaatgaggaaactagccagatggaaaattcacttcctcattttccttaaccttttttccgtgtcttttccaattgcttagagtaatttcccatattctacccatctcttacgaacatacctagccctttaggattaaggaactccacagaagccactgacatttttttaaaaagtatttttcgacactcttaaacaacaaatgtcttccaaagtttctacaaaaaaaaaactgcctaagtctcttccactccaacaaatattttaaaaacaattccaattaatatggtatttccttttagttataatttaaatgaatactggaaggaacacaatatggtaaagcaatggggtgatctgtcaaagggattatctaaaaggtcattcataaacaaaccaaataatccaatcaatgacaaaacacaactgtggatgaattagtgaaattctaatttccgccaagcaaaaagcctaacaaatattcctaagttcttactgcatcaattaatacattagaaagtgttatttaaacaaatactgataatatttcaaaatccaacacattttcaaagccatgggtaaagagaataaaggatttagacaatgcagatctcactgctgggctttgcattcaccacatagctttcagagtaaaagttgccaaattacgttgtcctgcaaagaacattaaaatcggtttctcgtaaaaaatataaaaagccagatccatggtgggatagaagctgggtggcaggaatcagctctaggactcaaagttcaccatcaatttatcaaggagaatagagtttaattttaggacctctgtctatccttatgcctataaaattaaaaactagtctgtttttatgtacagtaaaaataaggtagctaggaaggaaatcaacaaatgatcttcactaatcacctcccacactgtgttataagccttaaaggttattttccttcacagcacaaatcacaattatatgtaataatttgtagaactttaacataatatctcctccaataaactctaagtttcatatcagcagggagtatactgtattcactactatagtcttaatacctaaggtagtatatgtggcatatagcaagatcacaaatatttactaaacaaatgaaaatctgcacaggaaaccaagaaatgttcacatgtaaactggcaaaataattgcttttaaagtactggggggcagaaaaggctggatcagcaaatcaaaaactgaatagaaggacaatcaaaaagagcaaaatgccattcatgtcaggaggccagacacaataaaataataaaatgttaaatgctaggaaaagagagataagtttaaagttttaaagtggctactaataaaaactttagatgtaaacatttcaaatattcataggctatttaataaactgtcatcaaattgccacatttctttgagacgataacagagaataatcacagggaatgagagagagaaagaaatgttagccataatgaaaaattccttatgggtaaagttccagaaaattccttaaggagtctgaactataacacccaaaacttaacaaagtccctggatctcttaatgcttctgaattccatagggaactggggagctacaaagcattttacccaacaaaatctctggtagtcttcgccaaatttaaggaaacacaacaaaaattaaagagaaatgatacgtattaaggtcaaagtttaaggttactatgtcctataaaatgtgatgatgagtaaaatgctattgagctttcaccctcaacaattaacttctgcttcatcctgtgatattctaaattacagctaaccagtacggagcagccttgtcaggatcccacctgactgctttgtgcatagcctgttggccaattttataccagaggcacctgcttgaaatatgtagagacaatctgatgaccttattttctcacgtttacaccagctttccatagcacaaggacaatatttatactctaggaagagtaaaatatttgcagagataagaaatcagagaacatgttggcatgaagctatttcagcttctcaattctaagacatttggactgaaagatgcacccactaacctcacagctttgggggacatagaatcaggacattaagtaaacttaagagactcaaaagtaatataaaaattgcatatctaagacatgagaaaacatgggattagttaaggcagtttttgcaaaaatttccctgtagagattgaaattctagtaagattacctatcattcatgatttacttacatatgcaaataattttcaattgattatcagtctcatgtactatattctttctttaaattattatctctattccagacttttgagttctgctgttccagtgacctccacaaattttcctgaatttctcctaaaaacacactatgtgagagatcaagtaatgaaaaagagcacatggcctctttctagggaagagcaaaaaggtcattttgaatctgtaattctttgtcatccactcccaaccaatttttctgacagtaaagttggagaaacagtaaagttggagaaatactgaaaacttactggagaaaggtgaatcaagaacaatctttactgggtgaatattttgtttattccaatttggatatcaaacatcctattgaacacttgacctgccatttttttctcagaacaaaaagtagtatttctaaaatcctgcctgattgggaacacattttttttcataaacttaacaagttcaaaaaacagcccttacagattatctactacaatgagccagggttatctcaatgtcactttcacctttttcttgattttaacagcatcctaaaaaaagcctgaagacagtgtcttcatttccttgcttacagaaaataaccaatccatactttgtatggttccaaaaagtaatcctgcaagtcaaggatgccagctggcatcagaaagtcaccagcctgtgatggaaatgcctccagaagtcacccagtcatggacctaaaataatccaaggtcagaatcctggccctgaggaacaagttgtgggcatactgctaggagtgctacagggaccacagtgaagctttaaaaaaaattataaaaataaaaaataatcctggtacaacaaccccaccactggggaaccaaacagcctctaaagcaatttaatatggaggtgagatacaattgctgctggagtcacaccattttatttcaaaacacccctaagagaagcaatacattctcaaacatgaaaactgagttgcttcttggatctgatttcagccaccttaaactacagccagcagaactaccaaaagtagaaagaacatcattctgggatccatggaaagaggtacagaactaggagtctgacctgatcctacttccccacttggttgtatccttgggcaaaccacctgacctctgagcttcattttcctcacctataaaacatcattcccagggagctgtggcaagtttctataaggacagaaaaacttggtgttaatcaccattactagaggaaatgctccgtgtctcctggttccatcaccttgtggtagttcaccatcttcaattgccaactccacgtatttttctatcttcctaatggtaagtcaacaactaaaaagtggcagatccctgctgccccatcccaatccactgctaacttgactgtccaacacaaaatttcttactgttgcattctcaagggagagtcatttggaagttaccatagaagttgtacaaaaggaaaaccaaaacagatgtcttcactcttcctgtctaggtcacaaactattattcactctaaaaccaaagatttcaccctaccatccacaaaacaatgtttataagtcagccaaactgtttgggaaaaaattttttcaaaaagtccaagaaacaagaacacaaattattccccgaacagccagttccaactgaaggaatgagcctctccactaaatcaaaaaggtaacgcagcgtacaagctgttcgatcacctttcaaggaaaaaaaaaaaaacccacgaaacagtaatgcaaatgccattaagggagaaaagcagtggccaggcctcagaacaccaagcactggcatgagaaagccatagtcagcagcccagacaacacatgctcctggaagacatggccttagccatgaagatgacgcaaggagaaggcatagatcaatgctctgaaaagcaccccagcttctgtcctgttacttgcttcttgctcctgcaactatattcccaaaagggaggaagtcaaaaaagttgtaattattttgactttttcctaggtgttttgaaaaataaatgttatacccagaggaggctgctggcacataatgttgtcaacagaataaaactctgggggaaacacccagcttcatgtagtttgaaacacaacgtgcctcagatctactcttctgggacaacagtggaattaagacagtcacagcttgtctctctctagccacaccctcaaacttgagtaggttttgcagaaatacttttcacctgtgactgagctcctggcaaactaggaaatagttactcataccataaaagaaaatcaaaggtaacaaaaacaatatgggaggaacgggggagggaaataagacataaaaagcaaaaaatagacaaaatggaccaagaaaagacacagtcctgtccctaaagcaataagcaacaacctggcctgatcccttgattcccagacaacagggatatatctctttgcttaattcctcaagcactcagtttctactattaaatgcaagagtggggagtgtgtgatttttttttaagttatcattttctgcctcatctccttaggtagagaccaaggaatatgaggtaaagggcactttatacaagtctcaacgttctcagtatccagcactcagtaatttgtgatgaaacaataagtattacacaatcttcctggcttctgaacataatctcaacacaaaacctagaagaatatttttattgatccttcaacaaactcaaaaacaaaattagattaatttggaaaagccctaagcttcaagttaactagcagcccacatatatcaaagtcattcttattgcacagtagaagctccacgggaatgactcccaatctttagggggataaaacatgcttgtttttactgatattcaattccccaccccaacccagtaactaagccaccctgaggtgccgcaatgagatgctgcagggagcatcaaaaacaagcaacacgttcacctaaaagaatcatataatcatagaatagaagatgcttggtaccaagaatttttaagtgcctctgaaaaataagttccaaatgtacctacaatgattttttaaaatcatacacagttaattcaaaattaagtttttaagtgagcatacacttatactaacactccaaatatcaaaaaaaaaaaaaaaattggctgggttgtagagtaagccaatgcttaaaactgccaacattaagctattattctgaagggttttgctaagatgttcaatacaggggcacattctgattcatcgttataactggcctagctgaagtggctgccaggagagcagggttttatgggcattgttccatcctaagaagctacattaatgctgggttgatacaacagatcttcatatctatttaccaggctgaacaaaagttaactagaaatgtaagtgcttaaagtcaccaaaaggaaggctccacactgacattttctacctacttagcattcaactatattcatctcactagacattaacacacaccaaagttgctctctgctattcaaattgtgctattatgctcaggagtagattaatattatccaccttccttattgtaaaataaaattacagcattggtccaaacatgacatgtggagcctctttctacttctgctggtgcatcagtctgctctacggcacacataggagagggccttgctaaggctgccctgctgcttctggagtgggggagaaaaggctgaagactgaaaaaaataaaggggaaagggagagaaataacacacacacataaaccacacacctggaagtctcatatcggctttttttttttttttttacaacaatcttataaatctgttgtcatttataagctcacaacatcagcaatgaggttagcaggtgggccacaggcctcttttaaacagctcataacatcctatcagtttttacagcatcaagtagcaatgttgaccccaaagcatctgaataaatagaagcaggcaactggcagggagaaatccctactcccaatggggacagttctaaaatcccagggggggaggagagaaaaggtaagttaagctgagagaagctcattttataaaaggagaaactgtttttcaaccacgggttaaggaaggagagacccaagacaaatcttctctgaagtaaaggagactataagatctaaatatgtaaggagcagtttaacatgattcaaacattatctgtaaatacaagagatcaaacgaatataaaacctttagaactactgcctttgtctttacacttaactttttaattcacgtggctttaggaagtatagcattagagacaccaaggccaggcaaacaaaccaaggtcaaagtgaaacaagccatgcttcatccttaaggcgcagtcgataaatgtggactccattgttgttgctccatccttccaagttttcaagaagcaatacatttggctccagatctttatatattaccaaaccgtaaatcaacaactcacaactatttaaaacacagttcagggcaatcaaaacacctataggccatatgaagctcacggatcacccttcaggacctgtggcacaaataatttgtccactgataccaactgctccttctggtatcagtgattcacttggtcacagaagatattcttcagtaagtaaaatgtaacaaagtgcataagagccaatgcaaaagcccaagcaggataagaaaataaagggacaagtgagcaggttgcacctgaccccaaattaccaggacctggaactaagcacaaggctaaaaggataaacaagggacagagggcaagtacagacgcatcccaaagaggggaggaaggctgtgggtagttcaaattccttgcggagactatggagaagggaagagatgaaagtcaaaagcactgatgacctcgtatttgggaaaagtccatgggtcattcagaggcacaggacagaaaagaccccaagggtttttaaacaaaataagccagcaatcagtaaatagcacctggggagatcaaaagtggtgttgaataaactcaaatagaaataggccttacctgggaacaggttataaaatcttgctccctctataataaatgttgtatatttaacacattctggatacctctgcaataaaggtggatgaccccctcacctgccatatcacctccaataaagcaatatcagtataacaagaaattcttacttttgaaaagcagctcagagaaaacaagatcaagtgctccagaaatattttcccatccttacccaattcactgaatttattttcagatacactgtgatttgctttattctgatatacacaaatgatgcctaaagaataaaaaaagtgctaaacatcctttaaaagctgaacaagtgagcaatttccaataacttacttgacagggcatccatcaatgatgttcacaccatcagcaatgaggggaaaaaaatgtatttctatgtaaactccattttgtgatgtataggaatggatccttgataagaggttaaataaaattcaaatcagagaaaacgcggactattttaatataaatggttaaatttaaaattttgatttttcactgaaaaaaatatgagaaatttaaattaagaaatttatattcctggaatgttagctggctaaattctcagtctcatatgtaatcttttagcattatttatattttcaaggaaaatgcattttaaactttccaagtcccatcatcataggtataaatatgtctatttccatactgaaatgtccaaagtcacaattctcccaaatcctccctgcagtctgggatttttcttttacttcatggcagaaataaacatatgatggtgtattataaaaaaacaaaatcactaaaaatggttcataacacattgaaagccaaaaatataaaactaatcaagcagtaaccacctactaccacctttccaattcagtcaatgtcatttcattgtcaaaaaatcttgtacttcaatatgctcatctttacgtggtccttgagatggggagggtaagattttatacacaatcaaaggttaagaaaccaaggatataagtaattaaaccaaaccagatgctgaaaacttcagacttctagcctactattttccacctggctgtgctaaattaagaatttcaacctaagtgacaaaacctactgagacaactcagcaaattggccgcacgggcacggtgatcacaagaccttatgtgtgtgattatttgtttacaaaaacagaatggattttaaaacaaactatgagacaggaaagcttagagtcagtcatccttcaaagaatgctaaaggcccacatcactaactcaacagcagacaagaacctctgaatgacttcacccagttctcactagtataagaagacaactctaattgccaaagtcctatttcccaaatggaacctcattttaacacgctttcttccaaagtgcaaaatactaaaaactgtatggaaatttcttatttgtatatatttctctaggaagagacagctacagctttcttcaaatgcttaaagagattctagcccctcaatattaacaagaacttccaattttacaatgactctaaagaaatgcaggaaagctaagaatctcaaaacaactatcattccctagtcccataaagagatgaaattagtcaagaaagtgtgtactaaaagctttcagtaaaaaaaaaaaaaaaaaaaaaaaaaaaaaggggataaaaatccatcttgaaggaatagtttattgctttgatatttataaaagatttttgtgatatcctattaacatagtctttaaagttgctgaaataatctccaataatgaacaacccacaaaaacaaaatgctggaagaaaagaacatttagaatataaatttccctttcatgataaactttttaagtcaaaggaaaaacccaaggattaaatctatcactacagatggtccccaatttatgatggttcaaacttacgatttttcaactgtatggtgatataaaagtaacacacgtttaggagaaactatattttgaattttgatcctttcccgggctagcagtctatggtaagagactctctcgatatagggcaatggtagcaagccacagctcccactcaggcaatggatcatgagagtgaaaaatggatactctgtgttgccagatgattttgcccaactataacataaatgttctgagcatgtttaaggtaggctagactaagctctgatattcagtaggttaggcgtattaaatacatttttaacttaatgccattttcaacttgcaatgggtttatcaggagcatctgtattagattggccaacggaaaaatatacaggtacatcaaactgtagataacatacctggttcaaaatataccagtgctaaagcaaaaccttcactgtgtcttaaaaaaaaaaacctatcattttactgttactgtcttacagtaagtataattttaaatttgtcaagttttttaaaatacatttttaaaagtgggaaaggggattttgcatgtcagaccttatctcctattcattttcagtcagaaactgatgtaatagatatcagtaatataaatatatactaagaaactgcaagtttatttaaaaaaaagacactgtaaggcattctataaactggtttagttttatccccattccacctattcttatgactttctgggttattttacctattttactcctcaaagcccccatccttctcttcataaagatttcttacaacgaaaacctgtatctgttgtcacacagaactattcagcaatattcaaaaaggtaccatgtcattaagcatatcaattcagttcacgcattgagagcctaactcaaagctctgagaaaagaatgctcgttgcaaaaatagttatttttattaagaccaatctctagaaacttaacattgatattaaagatgaagatgtctatgagaatgcatttagcacagcgttgctcacacaagagttaccttttgttttgttttgcacaatggaatacaagcttagagataaaaaaaattcttcccttgaaataaaaaattcttctagccttactaaaatgaaacatatgatacacatcacacaagctgaaagccaaatctgttaaatttactagtgaaaaatgtcctaagtaccccacaaaaatctaagattttattacgcaaactttgacttttaattcagactccaaaagttatcatttaaatcataataaaacacttatcttttaatatgtaaaagccttaaaataagcactgcctttcaagcttaagtgtcttctgtttccacttggcaaatttacgttatgtgaaatccttaaataattaactagcactataaaccgtctagtatctcgaaccaaataaatatacaataaatgttcttcccaaattagaacatacaaaagtgtggatttggcactgaactacaatatgtgggctctgtgcgtaaccagaaccggtgaagacttctacacctgtaaaatgaaaatggccaaagcaagaaaaaattttatgcattttatgtcctccatagtgaatttgatagtcaggtgtggcatcactagacataaagccttcaaacagttctataatatatcaacaaagcagcaatactgacagctaaatactaacaagtgggaaggcaactaaccaggaaaagctacgtaatctgtgggtcccagtgcaagatgaaaatgcagggtaaccttgtccaaaaattcttaagaatttcaagattgggtaggatgtgcaaccataccggttacaagctggaaaagcagtcctgcccataactaagtactcacgccaaaaataaaattaacctccccccacacacactcaaatgtggtagcttactatcatttttgacctgtccagctgagtagccaagaaacaaagagctgggggtagactgagatgggcaggttttccacagggtggcacaccatctagcccccttaaaatgtcaacaaaaaagtaaccaaaccaagctaagtaccacagattctagcctctctcaattccaaataaacattatgagtgataaaagtggcaataagaatgtgacgatgtgatagatttaataagacatcaaatgggagcgaaaatactgatgctaccatgcagacaagtcatcaaaaaggggaatggtaaagtcagtcttgataagaagcttaagaagctatttcagagtatctagtcctttggggaaaaagaacatgaaggctaatttgccactgtggtgctcttgtgcaatgccaataatgcctgaaaagcgtcacaggttttttaaaaaaatgtctttcagcaaagaaagaggaaaaggttgatcccagcttaaaagtcaggatattctggaaggctttgctgtgtccttaaagagaacctaagacttgcttctagaatagaagtggggtggcaggaggggaggcacattatttttaaaagataagcagggaaggctggaagagccaagagcggttggttacaaggattcagctagcagcatctgtctgtgtataaataatcaaaaggttgattcaaggaatgatggtatatgacactcacagcatcattctcccttaacctaccaggagctgagtcttaactaaaaccactgaaactgggacagaaaggctttgtttttctcttgtgaagaggcggtaaccagaacaaatcaaccaaaaaaactaaatcagagaggatctataaaaacacatcttaggcctagaaaagaaaaaaggttccatagtaaccttttgacactgagtgtcaaaagagtggtagacactgaccagcagtgggtacttgctctaaacaagaagcatatcctataactaaaattatcttgaaccacagggaaagtgtgtgagcactgaatatagctgacttgattgttcctgaaagaagacactacacaatgaaggaaacacctacagataaggaagagggaggggcttaacacctaaagttgtctttcaaaggaagaaaaaaacaactaactccctgaaaggtggcagcacaaagttacccaaataacaggcaacaaggggctggttttaaccacacaaaaataaaaatactctctcaaaaaggaaaattacaaaggaggaatcacagaaaatttaatgtaacatgtttcttcatattctaatttttcctaccccattctggcctttatcttccagatgttttcttcctcttctttctctccccatagtttgcaagcgaacttcccgtaagtatatcctccccacaaccttaagtgttgttaccttagcatccctacaaacctcctataaagaaggcccctaccacaaatgcagtaacattcgggtccactcagcaatacagtcaccatttatatatacccaaaggttactaagacaaggtagatgcaggacagcttttccacccgctcaccaaaatggaaactccaggtcagcttccacaagaaatgggaaattcaagcgactctggcgaaacgattcttgagaaaactcttcaagggcaacaaaacaatatttcaaacaaacagattttacttgagggaatggggacattacacagcaattgatattcgaatggttttaaatggactgattcgccgtaagttttgaggctgagctaaatttttatgaagaattattaggaatagggccactagaaaattaagttttaaaagcgcttttgtccttgccgaaggtattacattttggcacttctaagaaccgttctttgagggagggaataaaggagagtggacaactcgtagcaaatccttttcccatgttttcagaaaatgtagagacgataggacttgaaaatctttgtcataaagatggtctttaaaaatgcacacaattctaaatgaccatctgggcagctacaactgcatgctcatagctcgcatctagaggcatggttttacgctctggccctgaaggataacaaggaggcttttaaggaaatgccgtgagaaagactgctggctaagcattgtcacggccactggaggagcacctgccagtgaaccgacgctggctcccccagtctcaccagtgcacgcacactagtccgtgcaccccggccgccgctggcaggccctaccagccaagctggaggagcagctgccgcaaccacggcaagcgaactgaaatcccagagccggcctcgcccggcagagcgcccgcgcttcccgcgcagcgcacgcctcgcgcgcaaacccgagatgtgaccgcgagctgcgacctcgcgcggctgcgacgggcctcacctaacgcgcacgaggggatcatcattgctcctgccctgggcgcccgcggccctacaccacctccgcacacaacgcggccggtgttaagtctccaaacgccccgagagctccaaggaccgcgcgcgcgaaggcgccgtagcaagtgggcacacaccagacaccaccccggcgtgttccgcgggagaagccagtgcacacatcctcccgcaaggcggggttgccagtgcaacacaggaatcctgccctttttctagaaaagccccctcccccactttccctccaatacactcacctgcgtctcaacagtttccttcttgcgctacacgcggccgcacccgggcacgtccacgcccgtgcacgctgccaggcgcgactgtccccgctcggctcccgccgcccccaacctgcttgtgcccacgggaggggcggtgccacctcccgaggcgcccaattctctctactcccgccgcaacgggctgagctctaggaacttcgcgggcacaacctccgccgcccccaccagtgttcccgcccagagttcggact

SEQ ID NO: 1135 - DNA, 131742 bp, Homo sapiens
tttcccttcaactttgtttattgatgtactgaacatgaaaaagtacaaagaatccaaacacaaaagaaaacatgtacagcctcttaaatactcaacagaatatattttctattccaacagatgtgaattaagtcatactgtacaacttcaaataaataccagccttacattttattaagtgctctgataaaacactgtaaagtgaagcacaatttgcatgccctctcatcaatgccttggtttgctacagtagtataggaaagaagcatgtagctgctgttttcccttgagggaaaccttattatttttttttaagtatatacatgtattttattttttagtgtttttctttttttaaacgcagaaggttaactctggcaatctaaatgcacctaaggatatgagaaagtgctaagccaattgatttctgaatagcattgagtgggtcagcatgaaaactcgcttattcactttagcacgcgcctcacagtatatgtactgtactatactgaaaaattttataactacaattttaaataataaaaaataaaactcaaagcaaccgcaaagataatgtacaactatgttatgcatagcacattgcctgttctaaggggaagcatgtgagcatctcagtttatacaaaaagcaggacgtaactatatagttctcagtgcatcctgatgaaggcatttttgccttcagcttttttgaaaatttattataagctagatgctaatcagaaaatattttgtattttttaaaatttctttcatacatggtaaagacttattttattatttccccaaatagtggtttttaagcatcatacaaagttaaatttcaatagcatacagatatttatgatttttgtatgaaaaatgtaaggaaatttgttcaaaacctatggttatactcatttttttataccacaaacatatttataaaccaaaatgtagcatcaccataaacagctgaagctagactatctacagacaaaatttgcaacaaatctgatgcactgtaaattcaagtcctcaggacaacaaaagtgattaagcaagacctcaagtaacaatgttaatgccatttacaaaggaaaaaactgatacaaaaacattcaaaacctgaacatcacttggcatgtaagggaaaaaaaattaaattagctgaaaggttcataaacacaaggtcttatttacattacacaaagctcaggtgttagccttgaacgtaactttcaaaataccttcaaatatatccaactcagatcacttttgctgatttgctgcagtacaaatcatgtgcaacgtcttttttccttaagacaaaacaattcttcaaacaatactgcaagtacatcactaaacaccatgagctctatctgaagggatttctttaggaagaacagattttttcccccatctctcggtaatttaaatttcttgcctgctcttatatattcttttgtaaattttttttatttgtttcaaaatcacaaatcaatgtgagccacctatcacataataaccaggatgatcagacgctccactggtgattacaaaaatgaaaccagcagtgtttccccccattgattctactcctttcatacaaagatctcaaaagtattttctacaccataaatctttctaaattttccaaccgctgcaaatttcctggtaaattttaaaagctcactaggtgtcatatgaagagatttctcaaagtattcaagtcaaaatatttgttccaggaccagtaaaaagtttctccaaattttcttttttataaaaatagatgctttttttaaacccacatcaaagaggctcttatctctttggcaaggtactgctttacgaaaagttctccagtattcttacaataagcgtttataatgtagcccccccttccccaacccaaatcataattacaaaataaatactgttttaaacttcataaataaaaatgtaaacttcaaaatacttttcttaaacagacataacagcaatgctttaaatgtaaaccaaacacaaagctaatcagaaaaaggaaaaaaaggggggaaaaaaaagacacaaccaactgaagaattacaacacaaagcctcaatatttactcacaggttcaaggcagttatgtaaaaagaaaagaaatgtcttcccttagctgaaacactttaaaaggtccaccttcttcaaagaaggcaatagaatgcaatgtgacaggtaaaaaccctgtacctcttgtccatattcaaacataaaagatatttaagaagttttaattcaaatactagcaataaaaaatctcacatatttcttaggatgctaagtagtcattttatccccatctcaacactgacttacaaagacatttactaatgtataaagtttctcttaacttgcctttgttgtatagttttcatatataaatggactgaggacaagagctcattaggctttgtgcgttttgtttgtcttaaaggagacctgcagtactctgtctcccagacggtatccattgaggctagctatcgccatggcagcctcatcatagtttgtcatagtcacaaatccaaaacctttgcatttattggtgttaaagtcacggatgaccttcacattggtgacagctccaaaaggcccaaacatttgccacaggatactctcatctgcgtcaggagccaggttgtacacaaatatacaccaccctgttccagggtgcccagggatattaattccagccaaactggtcattccgtcaatggtcattggagaaaacctgctaaacagaataggaaatacacacatacacacaaaaaataaaaacagaggttggttatagcaatgaacgtataccttttccatccccaagaattttagtaactctcctcccccaacaaatatataaactatttcatgttttgaccaaggtctgtgtgtggctttgcagtgacatgctagactactgagatattaataagttatgaaatgaccattattcactgtactgaatatcatccacaatagcaaagaaatatatttagaactggcttcatgaattaagcaggattggcaggggaagggatcaacacatacgtaaacatgctgtaacgtcgtaacgcaatacgaaacaaatgatgggtttttaaaagaccaggtggcatccggtggtataaaaatttcttgagtcaattgtgcttcaaagagcagcttttcattaggttgcacatgcaaaataaaacccaacaaaaacttatgaggggtgtgaatagcactcccaaaatcaaagaaaccaatcaactgtggaaagggattatgagtatcatgaacctctatcattacctctttactccataagccatattgagcagattgtccaacctgcaaaacacacatttagcaaacttcagtttttaatttttccccttgatgttcaagaaagttgggctcattactgccatcttccgaggggatatctgtacactgattatatgtgaagactcagaatgctgggtctttttacgtttttaagctaatgggcaccgactgccacaggacagttcttccaatgaatggtttctctctacaagggtcagtacatgggacacagtgacggtcatctgaggatacctttcagagaggaagtgcgaaagctctgggatagttaactttagggttctcatcaggtagcttcaaagtgatcaatgtatagctacatgttctttatactacttttgattttcacaactctgttggtgcctgcagatacctaaggcacacagggtttaagtggcttgctcaagaccacagggctagtaaattatggcattgatactcaaactctgcaggttacagaattctatacattttcctttcatttcccaactttgaagggctttcatcttttagaatcaaggaggtataattacaggtagaaaaaaccttatggacaacccaagctaaccctcccatttctcaaatgtgctcagctgaggtctagagaaggaaaaaagaaaaatccatcactccagtgtgcaacaaagccaagagttcagatcctgatctggatgctgtattcaaattacgctacaggaagtgtcgtcctactcagttttcaaaggccaggtaggaaacaaaacaagccaatctgagcctcacttaaaatgtttatagaaagtaaataggggtgggggtggaggtgtaagtactctttaaaaccttctacatttttcctatatcaaatattagttttacagcatttgactcttctttatcagtttcaaaacaccactctaatgtcccaaatttccacagtgcttaccaactaattatgtgttctgaggaggaggcataacttaatacatagtccacaaccaccctcaactgctacaatgctcaacactctccaaagacatcccagggttgtccctctgggactgggggtgggggtgagaattttttctttaacacccgtgaaaggtaagtttgaaaagtctcagccttatcacctaacctgtggcatcaagtcacgctaaagtatacatgcaaaagccaacaccttttagttttgtaaaagccaaaacacatctcatctggtctttcagaatggggaaatatatagcctcccacatccctgccctcagtctccactgaaaattctgttttgtaaagatgagaagaactgagcttatgcaaagtgtaaggaaacagaacagatcacaatgacaaaagatcttcgtgtgtgagtgtgtctctgtgtgcgtggtgcgtgtgtgtgtgtgcgtgccttgacccaccaccctctcattgcaccactgagcacaagccagggtcactgatagtttataataaatatgtgatgaccaaataaagacaatgaggttaccaaaattatggtcaacttagtccagaatgaaaactagtaagaggattggttggatgaccttgtctgcacataagtaaaaagatgtggggttttattttttgcagaggtgagtacagtcaaagatgccatgcctttatagtcaagaataaggatcacaactaccagcaataaagacaaacacatattagcaccaccaatcataaagtaacaatacaattttatcaaattgctggaatgatcaacacagaatgcatttggcatatgctacctgtagaagagaaccgcatactgaggtctccaaccaaagtgctagaagacccagaatgcagaggcaccttatcaattcactcaaaagttacatcatctatgcccattaattgcatccatgtagggacaggtcatgctttgctaccacccactcaggacaccaagcatacggcccagagacagatgagttttcagaattttcaaacagggtagaaaccaaatctgcccctgaagtgaattaccgtcaggccttttttaacaatggggatatgttctgaaaatgtgtcactaggtgatctcgttgttgtacgatcatagaatgcacttatacaaacctagatggtaatagcctaccacacacctagttatatggtatgggctatggctcccagtctacaaacctgtataacatgtcactgtactgaatactgtaggtaattctaacacaatgctaagtattgtgtatttaaccatatctaaacatagaaaaggtaatgcattgcacaatattaggatgactatgatatcactagacaataggaattttttgcagtctactatattatggtaccacggtcgtacatgtgattaactgaaacgttatgtgatgcatgactgtacatgcagtgagggagaaacatttcgttttccatcctccatctccctcacttccatctctggcatccccagacaggaggtttcgaattttttataacaggatctccgaggaccctccaaattatgatagggcatcttttttaccctatctgtgaagttttacatgataccatgatcttcactgattccttcacttctctctcattttagaaaaaaattggtcctttggaactaagccaagttatccactctaatctttcttctcctccatcaccaacgagtgtagggagaagcatggaacctagaaaacagtgcccaggcactgctgaagccccctgactgtatgcatctgagcccagaagtatttcctagctttctcggtgccatagattcatgtttcccatgggagctcagaaaaggcaacgggtgctctacatgggcaccattcactccaaatccagtagcagttggcaaactgtaacacaggcagttgtaagagaaaatagtgcagcagctcaaacacaaggactactacaacaagcccctagaaatatgtctgctgggtctgtccactgctcaaggacatctttttattttatttatttatttttgagacgaagtctcgctctgtcacccaggctggagtgcagtggcgtgatctcggctcactgcaaactctgcctcccgggttcacaccattctctggccccagcctctcgagtagctgggactacaggcacccaaccaccacgtccggctaattttttttgtatttttagtagagacggggtttcaccatttagccatgatggtctcgatctcctgacctcgtgatccacccgccttggcctcccaaagtgctgggattacaggagtgagccaccacgcccagccatcttttatttatggtcatttataaatggaagtcaatttttaaatggagagcaagctagctgcctccagaatatctcagggaggggtgtggatgataacgtagtacatatggaaggtaaatattaaagtatccattaaatatatatttaaaataaaatataaaataaatatgtatttaaaataaagtattttttacttatatttaatagatgcactgaacccagtaccttctcagtcctgtgtatcacctgcctccctgggggaagactgagcaatcatcgaaggggagaggcggcgagtggcactctctcctgctctttagcctgaacaaaatccattttacaaataacacagcaagcagatatggaggattagactggataacctgctttaattaaaatgacctccatttaaagaaaaagtaacttaaaaaaagattactacaaatgtaaatcagagtaaagaatggtaccagtaagggaaatacaagtaaataaggaaagggagagccgattatttctcctactcttagtacaagctacattataaggttagacacaagataatccaacatgcatcacatgaagtcagatgagatatctgaaattattttatggtcttgctttaaaagacatttattaagatattaggtacatggaaaatgaagccaaccagtatagtaattagcaagacatttaatacagattgtctcatctttatccttttttatgtttgattagagtttataatttaatgaatagcacacgcccatgtacatatgtaatttatgaaaaaggcacataggagagagatgtgtataaacatttttctatcaacaggaccaaagctccaattataacctgtcaaaattttgaacagaaccatgtatcagatcattcctattttaaagctaggtgttcataagtagaaaataaaaataaagtacctgcctaatttctaaaaaaattagctgatggactatgggaaggcctacatgtaagtaaggggaaatgtgaacccgattaaagtcagaaataaaaataggaagataagttattgatgggtaagaaaatatactcggaatcccacaaataatgattatcaaaatctctccaaagcgccaaccgagaactgcttggaaattatctacaacaagatcatcttcttactgccttactgccttattcaattagatggtatcatctgtcctctaagaaagaggaaaagtattcaaggggattgataccggtttcttccaaaaggaaattgtgataatgcaaccagtacgtcatgccttaaaggcaactcaagtgctcatttaaaaggctttttaaaaaatgcataaaggctcatagaagcaggcacacaggtcattacactagatcatattcaataaaattatagctgtttcacagaaaagaacatgaaaaaatttggcttaaagtttaattctgatatcatgtcccaagaatatacttaaggggcttgaattacaccatccatccaaataaataaggcttgtcctattttgaaaactgcagtcaattaaataagcgtattagaccagcagtgctcatattacaacaattctctgattattcatagattgactaagccataaacctcacaaacccacctttaaacttaacccttattacatggatttttaagctttttgaccataaaagatatggctcatactttatgattattaaaagtattcttgaccataatacatataacttatattgctcaatctctctcaactcccaaggtactatgagaacataaaaatacagtgagaaattttctacatgtctgctgaaaggtgacaaaaactcaaggcaagagcattaaaacacaaatatcagggacaaaatatatctgtgtgatgatttagactcgaactacagaaaacagcaaaataccaacaaaacaagcaagcccttaattcaagtttctttatcaggtgaaagaagaagggggagtggggcggaaatcaagataatgacaaccaggttcaatatactgtattaaagaaaagcatcaaacatcaggttaaacctgaaatctgatttcttccaacacacccaatctagatcaaacactatctctgagcacactaactcgttcatattttattatctggacagggatcatgggaggaatgagaaatggggtgaatgggacaacagttaaaaatctgaagagagaataacaatttctcccattttctgaaaccaagtttcccttacaactgacaatctcttattctcttcttccaaaatgtctttctataggagtgaaggaaaaagaattttcaagttaatgataacatatggtactaaaagataaaaacacagaatgggccagaaaaagataattaaatttgaccataagaacatcctgtaaagctttactcaaccaaaaataaaaagcacagagcctgcagggatggaggctaggtaaacctaagggctgacacccatcaacaacctagcacctgagtcacctacaagccttgccatttcaataatcaggcactctcccaaatcctgtcttctcaatcttcctaagaattcaatcttgattccaagaactttgttttacttaataactatcaaacaaaatcattgcttcaatctggaaaaaaaaagtagctaatatagctttccactaacagcaaacattttataacttcacaatgttaaaaatcaaccaatacattatgaagaactttgttctatctaaactcgagatcattttcaaggccccaaagagctctgaaattaactggacaagctgcctaggaaatacctgtaaaattccttcaggcttgttcatcctacgtttgcaatttaaaaaagtatatttatacatatattattcacttaagatgtcacagaggaaacctatgtgcagagctgaaaaagggctttctttgtgagacttctttctccacaaaggcaagcatcaggcagccccacgcatctcccacactagtctgatcaccactaccatgggaagtcaaaggtggcaaaggttttttttttttttttttttttttttttttttttttttttaataccaatgccttttcctcacagcagagcatgaagtacaaggctcaatgcttttgacagtaccacctcttctcccacggcaaaggccaacttaagttgaaatttaatgtggcattcataacaaatttccttctcatatctcaagcaacataatttagtatttttttaaaaggagctatttttaactgattttatctccactctcttcagcactgcaaatattccaatgaaaaaaataaatgcatagatttaagctagaaaacataactcctgatcttattaggttatatttgtgattatatttttggtaattaactattctgtcccatgaatgaaataaataaaattgatatgcacttggaaataatttttaaaaatcagtgtggggttagatagcattctgggtatagtgtaccatatggccaaaaaggatatttaaaaatgtcctggaaaataaaaactgcatgacttgcttatgaaaccaaaaactctctgctctgcttaacttcttaaagtcactgttcttctcacatgcagattagagattttttgaatgactcctggtttgttatcccaggatcagaataaaacttaaacagttagcatatgtacacctgtcagtgagatagagtgtcttctttgggctaaagccacggtcattctatgaactacagagaggtcagtaaattacaaccgacaggccaaatggagactgcctcccacctgttgctgtatgggctataagctaagaatggcttttacatttttaacaggttgtttaaaaacaaaaacaagacagatgcaacagtgaccataacccataaagttaaatatttactatctggtactgtacagagaaagtctgccaacctgtttgtaaacaattttgaaaaggaagagaggaactcatttgtagaaacttcacgtagtcacataggttatatacccttaatggtgcacatactataaagtgaagtaacagaaacagcttgacctaaaaattgacacatgagaataaaatcctttaagaaaaaaaaaaaaggaaatctgaagccctggaaacaattcagataaccccagaaagctacagattagaatttctcaaccacagcattattggtgctttggaccaggtaacttctggttgctggggctatgctgtacactgtaggagcttagcagcatccccgacctctagcattacatgctagtagcacccccacaggttgtgccaacatgaatacctctagacattgccaaatgttccctgggaggcaaaaatcacccttggttaagaatcactgctgtaggttactgtcctttggtccccaccttcaatattagcaaaagacactattcctcaagtagattctctctgtgcccatggagatgaaaaattaatagtaataaaaccaacaacactgacaaaagcaaaccagagatcctgtcaataaaagtactggacagtaaacctgagtattctctttcagtttagtagctgggcacaagaaccaaaccagacttacctaaaacgctgtgcctgctgagctagcggtcctggataccttctgtttggagactggtacagctgggaaaggatggcctgattggttttttggcttgggttattagcaaactttacagtgattggctccgtggcaccgggaggtttctggccatttaggcctttgatagcttcttctgcctcaattcgcttgtcaaatcgaataaaccctacaccccttgatatgcctatggtagatttgagtaaagatttggaaaagagggaacagaaggagaagggaaggagagaagaaaggacacattaatttttccttctcaagaacatgttttcacctacatataacatttcccacaaaatcacaccaggaggaaactttcccctttacttactagccattcagtttagaatcacaattttgcatttttagaaaaattcgtgtcacttacataatctgagtacccattatcacatgcattccaatcagctaagacaagaaaacacaagcatgtccatgttttctctctctcccacctccctcccgtacactcttttaatgtcaatagtgtaccggagttccatttttcaatttgtgctattggataagcagctcagaaatgagggacacagtagttcctgtccttgaaacaaggagaacagaaagaagaatttgctaaaaatgctacaaagctatgctaaaaatacatacactgtggtagaaagacatttcggttgaaattttaaataatatattcagcttaataatattgcataggatataggtcctttaggaaaaaaatgcctgaaaatgctcttccagttctctgaagctctcttgtgcttctgactagctatattttattacagaaaaatattatatggagaaaaagaaaagacgtagattttaaaaataaataaatttctagaagtaaagcatcaaagctttctgacctcagcagcatcactcctgactacagaagatcactccctgccccacattctccccagtgtgaaagacacaaatgggaaaggatagccaagaacctttccaggttatgaaaaattgtagagggaaacccagcttattccatttaattagcgtgaacaggctagtggggtgaccacagctggtcatcatgagataagcagtggcagggaaattttttttggcaagtaaatgagcactggaccatcatacttggaggagcttaaaaaaaaaaaaagaaagaaggtctacttgctttaaaattaatactgtgtaaggtcaatgactaagaattttctaatgtagacaaagcattttttccacatatgcgtatctaagacagcccctatcactttaccttttctatttaaagagcatgcattgcacattattaccacctgatggctgaataagaaaattgcagggtttcatttttcatttcaggtaaattgagtaagttcactttgaaagccttaagtatgaagaataaatagtgaaatgatagcaaatcctttcacttatctactagcgcctattaagaattaataacctctagaatttagctgttccattagaaaagcatcagattagcaaaaaaaaaaaaaaaaaaaaaaaaaaaaaacagcctctacacagctagagtcacctaaatcggtggtcctcctacttaagcatacctaagaacaacctgtggctcaccctcagagatttattcagtaggttctgaatgaagcccaataatttgcatttttagcagggttccagaagactgctgatactgcaggtgcgggacatacttgagaaccgctgactaaaacaagctaggtccacctgtgatggactagcaggtaaaagatgagacgcactttgtgtcataggtgaaacctactctcaattcacaagatctcagaatgaatgaattagaaagcacaaatgaaataaaaaatatttttgttgctttgaacaaattcatctttatttctaggcctggatttctatttaacaccattattagtctatgtgataacaacacagggtggcaatgtataagtattatgaattaactaacacaattaaggaggctgtattttatatactctcacttgactaaatagtctcatgacagcaaaatctgtaggctattctcccaggcatgcatgtagtgctagctctctctactcagaactctaaaggtggtgcttcctatgaagccaattaacaacacagaggcaggtaatatgggctcctctgattagattcagatcaactaaatggatcttcacttgatgaatgaaaaatctggctcaattttcttctgaagtcactgctttaaaagaattagacattgtaatatacaacatgcctccaaggtattattattatacgggtggcggggagagaaacaaacagtgaggagaaaagctaccttaaaaaaacaaacaaaaacaacctcacaaatcttcatgtggctgcttcagtctatggtactacagctaatatttcctcctcacaatgtttctctattttttaactgtttcctaaagaacaagtattgctttcattttattttttacttattttttgaaatggagttttgctcttgttgcccattgcccaggctggagtgcaatggcatgatctcagctcaccgtgacctccgcctctggggttcaagtgattctcctgcctcagcctcctgagtacctgggattacaggcatgcgccatcacacccagctaattttgtatttttagtagagatggggcttctctatgttggtcacgctggtcttgaactcccagcctcaggtgatccgccctccttggcctcccaaagtgcttggattataggcatgagccactgtgcctggccaagtattgcttttataatagaaaattgtatctgtattttatttttaaaattcataatcaaatctatattgctatagctttgttaactaagatttggcagaacaactcccttacattcaagagttttaatgaacattttagtcttcccatttcagttgggctaacagtgatattaggaataaaataaatttttaacattcaaaatttcaaactcttacatatgcccatacagcacagcatgaacctggaaaacagcctgaacagcaattaccagtgtggatgtagtgtaatcctcccttggagaactagctgcataccgctgcattaaacttcgctttttgacaaaagaaaggttgtttattagtactctataagcaggatgggggcttttatcacacagtggcttggaaatgaagattatagcatctataaatttattacaagccatgaaacaggcttcaatcctgcaccttcagggtggaaatgactcaagcacgctcactatactccacaatctatttttatccatgcatatttatgaacaattccagcagaaaattgcattttctggcccacatatacctttgatatgttctagaagcaagactgctacatggaaagacagaatatttcacaatctgctagtcagagacagggaaagactgtccggagtggctgtctacttaccagtgacctggtcgacaagaatacgagaagtaataatgcgtccatattgtgaaaaaagctgttccaactccttctgggtcattgtttttggaagtccgctgacatataaatttgcatctctgatagaagctgaacttgggcgagcataggaaacctggaaaaggaaaataaaattaaatgtatatgcatgctcactcacccacctccctttagaaactcaaaaactgcctcggtaactttcccatgaacagcatagaacactgaagttcaagcaagtcaggtgctaactgctttattcatttccaggaaaattctagacaaatgggtagtagtattcccattccctctcccctaggtggacagggaagagtatctgtaatatgctggactagcctactgcaagggacagaaatttcacaatatatcccatcctccagattattactaaaaatggtcaatgggtctgggatcaatttgcggaggtatagtgattcaacaactgcctgctcattttatcatttgtacccacctttagtccagttttaattcactaaaatttaaagttcttaaaacagaccagtggtgcatacagcacagtactgttcacaataataggctgtcttctgtggggccaatcccctagagcagtggtccccaacctttttggtaccagggactggttttgtggaagacaatttttccatggaccatggtgggggatgcattagattctcataaaaactgcacaatctagattccttgcatgtgcagttcaaaatagggtttgtgccctgatgagaatctaatgctgcagctaatcggacaggaggtggagcttgggcaataatgctggctcacctgctgctcacctctggctgtgtgcactggttcctaacaggccacggactggtatgggtccatggccaggggttgggaacacctgctctagaatagggatttaggcccaatcattctaagcttaaagattccaaattcatggaacatttttgttttctagcctctcacatctgtgtgggtggtagtgctacatttctaaaaaaaaattcacccttatcagtaagtatgctcttttgatatatgctgtatgattgtccataaattcccagaaatttgaatgtgtgaacaagccctcattatcctttgtctgttgtcttctcatccacaggtctttttaaccttgattttcaaaaggtcttaagtccctataattaactttgcctgccactgtatgtactttcaaaaagtttcatgtctttgagatacggtataccaaatcccacaaggacgaaagacaaaataggtctgcatgtatttgtttataatcatcattcctcatgtaaactctgtgagggaagaaaccacatcattcttggtcatcactgtatcctcaatgcctagtgagtgcctgacatgtgatagatgctaacacatttggtgagtaaagcccatccaataataccccattgatcatgcagatccacaacggcttactgaaccagagcatttaagggtcagttcaagtcatccagatctcctgccccaattgtaattgatgactctctgcctataacctatctttgccaacatttagtctcatgagctattcctgatcgcattccctttggtttagctgtaatattctggactagcctacttcaagggacagaaatttcacaatatacgccatcctcagattattactaaaaatggtcaatgtgtctgggattgatttgctgaggtaaagtgataactactgcctgctcattttattattggtacccacctttaatccagttaacaacaaactttcccaatttacactaatacttaaataacttttagtatgaagcaccaaacattttccccataatttgaattgtgcccacagctctctgttgccactttttcttggctttccagaaaaaaatataagccacattttatactactttataaagacctcgttatctttcacacccctgccccaatggtgttaacatttaatactcttctttattcaaaccgtttgctcattaacaagtgaaaatatacctgttgttccaaaggctatgtttggaagttatattagcactgtcctgttctacagaagaaacaaggaatttggaatagtggtggagaaaacatacataactattcatacgctatttgttttctctatgcctaaatacttaagaacaatgaagactggggaacttaaatgtaagtgaagaacaagtggccaatttcaagtgattaatgtaacttagatggaatcaaatcttgggattgctataaactgatgaaacaaggccaatgaattatatatgcattcagtaatatgaatcaatgaaaacttaatttcttttctcgtgtaagattctcaattatccagaaaaggtgaaacctcaccagctgggacgtgcatccctatctaggattctatggcttttttttccacaggagggagcacccaacaagtcagctgttactctgttccagatcatgtgactgaagtactcccattatgaacagccatgtcccatgggctccagggcaggcatctacacattctccaaggaggctaacttccaatgactgatcaagcaaccagcagcaggtgacaggctctgcatgagatcaagtgtcacaggaggcagtggaaatgtggttaaaggtaacagctaatcggtgtgcctgggctcaaaactaggtttaattcataaccagttctgtgaacttagaactaagttcttcaagcctattaccacaattctaccttctttatatggctattaggaataattaaataatttctaatccacatgaaaagcttcagagcctaatctatgtgacattataaatattatttacctctacatgcatctgaaaatttaggtaaatgcccagccccttaaagtagagagaaacctgggtccattacagtgttctagaacaatttactcatgcagtgacattcactgctttgtgcaattcagatgagtgtaggtggtgtgtcttaaaagtcatcctaaaatatatttaggaaaatgggtttatatttaatgcttatataaaggctttgaaaacatacctaggtcagttatgtgattttttttttccccaatgtccactcttcagtttatattgtatctttagttcccagccacattaaaaaggctccaagacaaaccttctcaaaaacagtatctttcagtgacattgtcaaagaaccattttccactaccacaggcaggacaggagtgattagattatatataaacttacgtcggtaacaatgtttaatgttaaacttacatttagggcattatgagacttcaccatttacaaggcattttcacaaactacaatattttgtctgtgcctcacaacaaccccatgaggtaggcagcatacatattagtattttatagctggggaaacaggcacagacaaggtaaataacatgcctaaggttatacacaactagtgttgaattctgggttcaaactctgatctttctctttctgtgtcctggtctcctcatccagttttccttcaataatactatggtaagtgagtgtttcagttcacttgttctgagttgggaaaaattaaatgaatcctggctgtttcttaaaggcatacacagagaaactggccacagacagaaaacaggatgttgctagaaattagttaaaagttattccactttttattattttgagacggagtctcactctgttgctcaggctggagtgcagtgggtgatctcggctcactgtaacctctgcctcccgggttcaagctattctcctgcctcagccttccaagtagctgggattacaggcatgtaccaccacactggctttttttgtattttttagagacagggtttcaccatgttggtcagcctggtctcgaatgcctgacctcaggtgatcagcccacctcggcctcccaaagtgctgggattacaggcatgagccaccacgcccggctccattaatatttttaagagtaattttttctaagaaaagagaagtggccactaattacaattaaccaaagaaactacacatcatcattagaatttttaaattaatttttgttactttctaattctcaggagtaagcaatgccattttcgttcactttcaggaaataaaggtgtaagaaagggtaattgccttctccttcctcccagaccaaggctcaaggtcctacccctatccctttatttactgttcttggaattaaaacagcttcctttcccttccactatcaaggatatcgctgtcatcaaaatcctcccttcctggaaaacatttcttctttcatctaaaaagattataaatagaaaatgtatttagacctaagtgggaagaaggctgatagtgggataaggactcacactctggagatcagttacctaaggactcacactctggagatcaaatcagttaccaaactaaattttgtatctgaccattaccagcaaccttctccattccgattttttttttttcctgtggatttagatcttacaggtgccttcatatgcacctacagaatcatacaggggctattttcagaaagtgttaagtatctttttggttctacaagactaaactcccttgaaggcccaaaagagttcgctttaaatgacaaattctatttagaaatgcttcaaaacaatggacttccagcatatgtcctactgaggtcaaaatagcctctttctccactgcaatctgttctccattttccatttgctggattaatatatgagtttggattttaaattttcactgccacttaaacaggtgaatatttaatgcatgagaagcaaggttatgaaatgtcaaaactactaagtgaaggatctaatttaagaggcagccagagagtctgcaatttaaatatttaaagatgatacagggagtacaacactgaacaccaatctactccaaagatagcaatttaaaactcaggtttattctggaatttctcacaaaagctacgagtgatataataaacaaagacaagcaatactgagattatatgagggaaggggagggacggggaggcagtaagtacttgctactacaggtaagtaaatggcccatggcttctcaaactgttcttcacaaacaagactagactagacaaaataaagatagaatatatttattgaattatgtcttgaaaatggaaccgtttgaaatatagtgtattacttgtaattaaaagctcatttcttcatcagcagctaaaactaatgatacattaaacatacaaagatgagtaacacatacactaagagtgggctatcaaacacaagttgatcaaaattatacaaagaaacaaaaccatcttatgaattagtactttattaaatgtacatagcaatgtttaaaatcccagtgcatcactatcagaagtccctctaaatgctttcgtccaaacacacaactgctctcgtttctctgattcatcaatggaaagatcagtgacagtggacattaataccaatagattaaagtgataaggtctataaatgaacaaagaagttccctcttttttaaactaaaaacatttgagaagtcacccactgctaagatcaccactgaacaacttttatcacttgtcaattactgacccaggactacaaacattaaacctgaaaattagacacttgccactttagacttttttcaaaaagctcctttcaatctctccagctgaaaggtcacagttatgcctatttaaacggacagttaattgctgttcatattttttaaagatggagtcttcgtgggactatctgaaaaatgacactataactcaataaaagttagctctaggctctaagtaagcagtagcaaaggtcttgtgacagcatcatggatatttggacaggtggctacatcggaccttccaaaatgagctcagaagtatagtacacagaagaagggggatctctaaccacaactcaggccagagacctcaaaattcacccaaaaggaagatgtgtactttgatctgcttctaaattcaaactcctaccaggaacaagtctcaaacacacatcaaggcatacatgtatcacagtccaatattaagttttcaataaggaagggcatatttcacaatgggttgaaaatgaataagcctaagataacaataagaaattaagtattagctccagcaaagttagagctaaaagaaataatcacatccaaacaggaaattttataaaaggtattaaaggttagggcagttatctttaacggatattccaaaatataggatttagaaaactatcagtggaaaatacacacagaaccttaaattttatcgtgactggatttgttgaatgttttaagactaaacaattgctttaattcaagtgagaagttcagagataccacggaatatatttgataatgtcatcctcaacttaaattacctaaagggctccctaagactttcagataaattttagaattcttattcctttatggtcagagcactggctacctcttccatacaagtatacaaaaccttcggtagtattccaagcttcctgctctcacttctctgtgttaaaaataagctgccctccttccaatcagctaaatttcagtcatttcagacacctcatgggtatcacctagtccctaaagtcaacactaatcagtcctctccactacagtctgagttgggtgcctcttacctgcacccacactgcattatatgccttgttttcttaaatactgacttaaccaaaatgtacttatctcttaaccctttcttgtgactgacttaaccccttgaaataagaaaccttgtcatcatcctactttgtacatcctggtaactaccacacactcactgtaatgaagatgatttataatcacatattaaattgagagtttatttctgaaatactgtttaaaagctaacagaagccacaatctttgtcatatacccaacattatacgcattggtactttgtgtacagactacaatgaaaattctattaatcatttcaaaaatgaaatttcatttctcaaattggggattcaagtccccagaggcgacacaatcttcaacaaagtaatatggtgctgataggaggctgtggggcggggggagtcttaattttggagcaaaaagaaaatacagtgatcatttagtccaatttctttgtatctgggaaataggaagactgaggcacagaaaggtgaagcaacttttccaaagacacaaagaaaaagagttgggtgtaggactcgcggtcttagctcttcatcacgggattttccattacatcattagctgcaacacagtcttcaaaatcataaaatcttcctgtgaaatgacagtgactgggacaataatcagacatttccaaggagacatcagaagagctattcctagaaaataagaaccttagctttgctacatagaatattttcttgtatacacataaggaaataataaaacacatcaaaaaaactgtcttaggacagttattataattcttctactagtaatgcctgagaattatttaggagatgttggagaaaaaaatctaattatttgggagttgaagagaaaaatcaaactaagaatcctgagactagtactttccaccaattaaaacgtaccaacctacaatagctagaatctttttgatagtgtctctcccttttataagattacaaaccaattaacaggaaaacagaatggcaactggctgtttacactaggggagattctcattttcatagaattttcaagttttagtgcaacatcattaaatattagtcaaggcagttgatcttagcttcaacttaaaggcgacctaggaataaataagtaatgtcataaaaataagtgatcctatgacattgttaaagacaataataaatctactgaatagccacagaaaaataaaaagtgttttggctgtaagaactgtatatcaagcaactgatcatcaactacagacttcacaaattagaccacctttttcacacatcttaaacagcctctgacaaactacactgcactgagtgtggtttattaaatgctacccaaacagttgcatccatgtgtatcaaagagggtctaaataggctgccctgacaggcatctcgtttttagtaaagtacaactggtacataacttctgcccttttattgttgtttctccttggttctagtatgaagttggttcaacaaggacatctcatactggtaaaggcaaatgggatacatggtaaagatattcttgaaatgcaacttaggccataaataccttaccatttcttaaattttttacctgcagagatacttaacagaaaataaaacaattgagcaatggtagtggatatggcatctgaggtggaggcagtgaaatcaaattcactatggtagtggcagtaggctagccattccaagtctaagcaggaacttgtcaatcaaaatgttccatgttccatttccaatcctgtatatttcacttagccttttcagactttagaaggtgattacactaaagtagtataaaaaatagatgggagttttagcgtaaccaccaaagagtctattcctaccggtagctctctgcattagaaaattgtcagtagtggttaagaatgctaactcccttacttttaacttcagaaatgagcctgcatttatttagccacataatatttataaatactaagtaatgtgaataggctgcaactgaggcaagcacgtgttagcttagcaccaggttcaaaaatatattatacaaagcagaagagaatacactgtaactggtaaagttctggccactacacagcatactatgaaactagaggttaggatggaatgtttggaccagaaccctcccatgttaaggagtaaaaacatatggtatggagtcacacagagctaggtccaggtcttggctctgttacttaccagttaatcatttccttaggtcttctatctctttatttgtaatttgatgttaatcacagtacttacctcatggaaaccttacaagtattaaatgcaacaataaaactattagcaaagagcagaggaaccataaatgttttaatcataacatcattttatatacatacataggaaacaattcagataatgatagctcctaacacttattgtttaccatgtgccagacactgttctggatatgtaacatatgttaattcaattgctcctcccaataagtttatgcagcatcatcatccccaatttatggaacaaaaactcaaggaatactattatctttgaggtcaggaaagatgacacagaggaggagacgtggcacaagaacaatgtatgcactctaacacagaaacagttcaaaaatcacatatataaatgaggcttcttccaaatccatggtgataattattaaagttaattcctgaatattccaaatattttgtaagatgacagcagatgagtgtgctgggaagcctgcagcctggatggagggaacataaggaaggagctgtcttactgacatacagagagcaaacattcaacatctataaatgggccaacagttaaggccccaaaattttatttctcccatcaagctgttacatattaaacctctcactacctcaattctcttttgtagagacctgttgaacctaagccagtaaaacgtaaaatgagcgattcttttggatagacagtagtagaaatataaatgaacttcatggaataacttctatcttgagatgaaggttatgggtatgtttctgcatgtgaaatgtgttacaagctaccatgcaatcggccacctgatgattcaatatgatttcccagttaaaaaaaaaatactgaagaggctacactctcaagtaccactataaaactttcactttagacattttcattaaatatactatgaatacattcgagagactaaaagaaaaatctcagtactcactagtcagtactcagtattttgagccttcttaaatacggccagagaactagactgcctcaaagcttcctcccaagttaacagtattaccattcaaagcttttatattactatgttttatacttctagagggagggttgaaactaagtcttatatgatgcctatctcacatagtcccacccaccaagtagggactctactacctgttgaacgtatacattccatggccttgtgcaggaggtttttcttttttgaggcagagtctcactctggagtgcagtggcacgatctcagctcactgcaagctccacctcccgggttcacaccattctcctgcctcagcctcccgagtagctgggaacacaggcgcccgccaccacgcccggctaattttgttgtatttttgtagagacggggtttcacagtgttagccagaatggtcttgatctcctgacctcgtgagccgcccgtctcggcctcccaaagcgctgggattacaggcgtgagccaccacgcccagctaggaggttgttctgaagtacctctcaagcaagatgattagaagttgtggcatttgcccaaataacttggcttttgctgcttcactgaaaacaacgcaggctaaattggcttgcagaaaatcagatatattcattcaattgttagaagcccattctccagcaatggcttcagtattctttcaagattctgaaacttgacccaatgacatctcgaacagatgccaatactatcaagataaccatggcaactttatctccaaaaatgtacttaagatataatttgtgtagtatctgaatgtctagtatgcctaagacactgtcaacagattaaaatgctgagttagaatgttaaactaaagaaggactacacactggctggcataaataaactgcaggtgtcttagaataaaaaacaaccagtaccggttggtaatgtgaaaaaagaaaaaaggttctcatcaagccaattttggtgaattaaacatcctaggactttcatacacttcttcatccatgatctgacagagagaagtacatgaaaaggagaagtggataagacaagagacgggtaggtggacattatgtagaaaatctcacataacgggatacctttacttaaatctttgtttttcaccacatgttctcactcataggtgggaagtgaacaatgagaacacttggacacagggtggggaacatcacacaccggggcctgttgtcgggttgggggaggggggagggatagcattaggagatatacctaatgtaaatgatgagttaatgggtgcagcacaccaacatggcacatgtatacatatataacaaacctgcacgttgtgcacatgtaccctagaacttaaagtataattttaaaaatatgtatatataaaaaaactttgtttttgtatgaaacaaaaaagctgttaagtcctttacatatccttcatccgaccacatcttcaatgtatagtgacacctaccaacaagttttgaaaaacacacccaaagttaaaaatggcattaaaacaaaaacaaaacaaaacgaaaaacctccaagaatctcaacttttaatttcacttaaactgtgacttttttcgtctttgagcacacagagcaggtcttcactgtctcttataagcaatagacagaagcttcctcatgcagaggttataaataaaaacattctgcaagctgctctccaaagacaaaaatcccgttgccctcagagagcagaccaccaaatagatgagaaaggaaatgtatagttaagaaatttttatccactttattaatttattttatggccaaataaaactttatcaatgacagggttagagggccatgtaggcagagaataatccaaggcaatggagaattaggcttccatactgaatgatgaagagcccagctgagccagaataaagatttctgtaggacactgacaacactagaacagtgagttgagggcagagtctagagaccttgaatgtcagggcaaaacttttatgagcagaggaatgacaatctaaatgttggtaagtattatcagacagaaatgtatggaaggagaatacagagacagtttcccatcataacgcaggtgaggagaacagtcaaaatcagtgtggtagtaaagttaaatgtaaatgccatctacagttaagtttccctttgtactataactagaagaaaaactgctttgcaacaatgttcagaaacccaagtcttctttgacctacttcatatagtaatgaaaatataatgatcctttcctctgtgtgtacactaaatactgcttagagaaacttcatcttgataccatttgtaaatacttaaatgagtcccatgggtctccacggatctttgcagagcaaggcaaatatgtttctacgagcaaattacttgatccacccaaaattcattcctattgtttctcttataaattaggtcctcactaaagggggataaatgtaaagtacagggctaggtttaatcaaattttcctgccaatcatttttgtagaaggttattacttgatagaataagtatactttatggtgttcagatgtaagcttctcctaaaaggtacacatcacgtgaaggcctctgtgcttttgaatgagacattcccttatgtgtaatacatttcttctttttccgcccaataaaacctagcttgtaaaacaccatcaactctgaaatcaacacagaggcctctagacagcaagtggcatatccattttcattgtattctgcacttactcatcatatatccaaataatggtcatataaactaagtgctgtctcccttactacacaatgacatcaaggacaaggctacctcttgtcttattttaatgctgttcaaacatttagcaaagctaactagcccacattaagcactcaaaatgtttataaaatatttaattacagatactccctgtccaacactgtatagccaagattacatggtctcagtaaaacaaaaaaacaacttgcaattaaatacttctcaaaaacttttacatttgcttatcctggccctttgttttgtgggcaaggtgagcaccatgcacatcttttaaagctactgacctttcctacaaacttggagacaggcctattagtcttgttatggttccatataatataataaagccctaaggggtgggaagtcttgaacataaagtaactacttctactaaatctttaacgtattttaaaaataggattcctcaaacacccagagaaaaattcctaacaaataatcttcctcttaaaggatgttttatgtcaacaatccccatttaaacacctgttttaaatttaaaacacaatctgcaagccctatctacattacaagtaaaccatacgctatccaagatttagtgttttgggccctgatttgacacaattatcagggatctaatgtatgtatacaggtatacatacacaaagaagttaggaagccagctcactttctttcaagggcagcctgtctttggtaatcctcaatcagtagaaactgtaccagttttttaaaaatttaaaaagcagtaacagcaaacactgcagattgcttatggcatttaacaggcagagatggaaatttgtgtaaggcacgtatgataaaggagaaagcaaggaaaaagaataacagaaatgttattaaaagccctccccacagagccaaaggaagttttacctacacatattttgtggggctgacataagttatgcaactatgaaaaatttattcaatacataaggggataacccctgaaacattagtgagtgttgttttatgactttaagtctaccaagatatttctctcacaacatgattagacattagagaataaccatagggaaagctttttttaaatgaactgatttgcaagactaatagtctcattcaaagacaatccttcattctccaagtatctattagacacctgagctgtatattccccctaacagctttaacaaaaaataattactgtattcccaaaaccctttgtgtgacagttgtgaagattttaaaagaaagagtttttaaggaaaacatggacaaccttcactgtacgcaataaagagaccatatcattgccatctatgcaacacctgcagaaatttaaagaggggcagcgaggaggggaactaccacctttatctttgttctaagacaaagtgttctcctgcttcagatctccagaagcaccttgagaatcccgtcctgagatatttaattacactgaatgatttggtaccaggccctttccctgggtcttgctgactgatagcatcaataacactcactggctgtaattaaaccgccaaatagtatcccctttgccacttggcagataaatgttctttaatactccaaagaacaaagtacaaaggtgagaggggtgtttttacccctcaccttcacagttcatctgactttgtgcaccaggatatacatatactgtagacaatgcatattttacaattcccctcagacattgcttaatgaagaacatgaagaaaaatccttggtttcttattaattcatttttgcaactctgagcagggggaaaacactgtaagccttttggcaagagtatgcactgctttcacatagctttggggcaacatttggtttacaggtcaaaagggtttctaaattaagtttgcatatagcaaaaaattttttcctttaaaaaattatagcataaaatgtgtggaagctcttataatagagcaaattcccatttattgaggccctggctagaaagctcaaatatcaagacactgggtagggaaggaagaggggtttggttggcaggctataaaaataagacaaatttttattaaattttaaaagccacttttttttttttttttttgagatgggagttttgctcttgttgctcaggttggagtataatggtgtgatctcagcttactgcaacttccgcctcccgggttcaagggattctcctgcctcagcctccccagtagctgggtttacaggcacctgctaccaaacccagctaattttttgtattttaagtagagacgtggtttcactacattgtccacgctgatctcaaactccggacctcaggtgatccacccgcctcagcctcccaaagtgctgggattacaggcgtgagccaccgcgcctggctcaaaagccactttcaaaacttaactcccaatctctataagacaccctttcaccttttttttttgagacagaatctccctctatccacccaggctagggtgcagtggtgtaatctcggctcacagcaacctccgcctcccaagttcaagtaattctccctgcctcagcctccggagtagctgggatcacaggcacccgccaccatgttcggctaatttttgtactttttagtagagatggggtttcgtcatgttggcggccaagctgatcctgaacttctgactgcccacctcagcctcccaaagtgctgggattacaggtatgaaccactgtgcctggccaagacacccattttaaatggataggccctaaagaaccatactgaaaattctccaaataccctcagaagcaaataaattatgctagcataattgtaatgttgaagtatttaatgacacacaaatgccctgaaaatgagcaaattgtgtgtgagaacgtgcattatttcttaggtaaatccagcactatattcattaaaaacacattagtgaatcccagccattcaacatatcttgatgtaaccgacaaatgaaaatcctattttttacaagtagacttgttttaaaataagcaccacagacctacccaagtgcaaatcattaagatccactgaacagtgtttctcaggtcaggccaccatctgcttaagaatcacctgtggtggctgttgaaatacaatttcctcagtctctctctgcagataatcagattcagtaagtcctggttggggtgtagaaatctgcatttttaatcaaccaccccaccccactgatcctgataaacattaaagtgttggcagtctcttgtgtaaaggcatttgaaataatcctcaaaactctgggcatattagggtttcctagatagctcataacaaccacggatgccaagcccttttccttgccatccactgatcgttagtttctaaataagacaaatgccaggtagcttgaaagcaaagcatttaggaatataaatcacctgcaaatgcaaaaatgcagacgtaaaataaagcccatgaaactcatccaaagatatttccaagaacccagactggctggatgtggctcaactgggttagcctcttcaaaaaggccactgtgcttgattctatgaagttaggagcttctctcaatgactctttctaggaatatgaatatggttatttggttaaggcaagcacaaatttctagatagacatttaacaaccaaaactagaaactgaaactttttctgaattattagtttccaggactacatgcttgttctatttttccttgcccttcctgcagctcacctgatcaagaaaccaagaacagaacacaaatccaagacttacacctccaagtcctattgcagcattcaaaagagttcttcacagaaggaagggagaggaggcaggcaagtatcagatttcctgtactgttttcaaaatacagatgaccctggaacaatatgggtttgaactgtgtgggtgcacttaatatgggattttagaccaacccctccctcttcctctgcctactcaacataaacatgacaagggggaaggatccttatgatgatccacttccacttaatgaacagtaaatatattttgtctaccttatgattctcttaaccttttcttttctctagcttactttatattgtaataacacataatatgtaatacatgaaacatacaaaatatgtgataactgtttatgttatcagtaaggcttctagtcaacagtaggctactagtagttaggtttttgaggagtcaaaagttagactttttgctatatgggggctgctacccatagcccccgaattgttcaagtgtcaactgtacagctctgtctcattgcccaaaagcagcatgtcaagacacttctggaaataaaacatccacaagtaattctaatgtagtacatgcgggtgagaacacacactaaaagtaatgataggaatggctggcagaagtgaaaataaaagaaaatgcaccatccatgcttttttaaagagtctacgcaaatttaaagagagaccaatgttaacacacatttctgtaacctttaaactagcatctacgacttacatgaacctaccagaaaaacattgtcgaagaatgcgtagctgcctaaaaaataatttcaggaagttactactataataataattttactgttcattacaactgaaataactgaatcaatgttaactcacttatctgctaagtatgacctccagatccagttttcttctcaaactgtacgtctggctgtctcaagtgctcactctgcaagagggcagagttcttcactcctaggcaaagacagctccactctctggcacctaagagatctggtccagaaagtctcaagacaaagacactcaaaggcccaaattaaggcctctctcagttggtttatttagagtggtatctgagcaaaacagtttaacatcaataatgtgaaatggaaagaaaacaacaaaagctacggcatcagccaacatgatactacatttctgatgcttattagctatttcattttgaacaaatcccttttaacctgagctttatttcatcaaagggattaagtatttgcctaccagagactactgctgtttctgcacgaattcaaaacagtaaaaagataatagtcctatgaaatttgtttcaaaagtagatacagcaaagaattaagggctccttcttgggaagttaacacaatcatcttaacttcacaagccaggtatgtggtagaacagactgaagccaaactgacctagcaccacttttcccaggtgataaatgaaagaaaagccctaccccacattccccttaaaaagcagtgggaaagtaaagcaacaagggctagcagtgtgatgttcaggtagaaaagatttttgttttcttcttgtaaatttgtttgagttcattgtagattctggtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaactgaacaatgagaacacacggacacaggaaggggaacaacacaccctggggactgttgtggggacgggggagggatagcattaggagatatacctaatgctgaatgaccagttaatgggtgcagcacaccagcatggcacatgtatacatatgtaactgacctgcacattgtgcacatgtaccctaaaacttaaagcataataataatttaaaaaaaaaaaagaaaagatttttggccatccagatcagtttcaatttatcttatctcactgttatcttagaaatcaaactcaaacacatttgaacatgtggttcaactattttcagtgtcttctatcatgatgcacatggtttgcttgaatctcttcctcagcctccttattattcggaaaccaattttgcacttaacattctagacctgtgagctgttataagggttctgcctcaatgactcaaatttctgataaacagtaagtttcagtgacatccccaccacatgcccctttcaattccacacgtgcacacacacacagacagcaacaatttcctaaacctatacaagttattacttctgtggctttccccctaccttacacagaagcaatactcacaaggaggcagttactcttttaattccaatggaggtcttcataaaacctgacattctccatgctggttacagaaatgaaatagccaggcttttctggtatagaccatactttgcataagtttaagcatctgccatgaggggctatgatacccctgtggagcatgcttaggtaacaaaatgatccatcaattccaataaagatgggttcagtcaactgttgagactcttctaccatcactatccactgtgtggctgacaggcaggaagtaagcaggggacactgccaccaagaaccctgttcctcatccttccctctttgtaggctctgcctctgctccaacaactgtgggaaaatctaaaggaaatccattggaagaatgcctagttattgccctttgagaattccaattaactctcactttggagttggctaaaaggaacagaagtaacacaagaggcctgaggacaggacattcaagctctggaccttacttgggctacctacccacattccctagaccacattagatgagtaagaaatttctgggctttttgtatgaaaaaaattaaagctgacaagagagcattctacaaaacacatgaagggcattatacaaataacaataaaaaagtcatctgtgacttctcacttcaaataaggactatgtaaatgggactcaatatagatagaagcattttatttaaatgtattgaagaggtgctgataatcagatgtaatatactgttaaaacttgacatgtggctgtggaaatttccagaatacaagttaacaatgaagttaggaaaacatgtactcggtcagtctgtattttttaaaaggcagaggaacaatttactcaacgtttcaatttttaccccactcctggcatatactttttcaattttttttttgtctggataaataacagttattaggctaacatctcataagtaggtcagttaatttgaggcctgttcttccaactattacttctaaattttccaaatctgctcaaggtaaaggtttttaaatgaggggtactttgtagacgatgatttataaatttctaccctttgtaccatcacaggaaataacaaactacacaagccagaaaaacactagggtgggttgaaatgctgagaaagatgtggcgtttaaatacaaaacaaaccttcctctccgaataaatactcaaggtcaatcccaacactactctgctcaaaaccctccggtgccccttcctcacctagagaacaaaacatcagcgccttcacatacatgcgcacccagaacacacttctataacgcataactcaggctcatttcccacactcgcctcccatcctgctttctttttgggcaaattctatatggttcccctatcaactgctttaaaacttccatgccctactaaagtcatgaactcccagcattatggctattagagccactcgtctcaaacacagaactgtgctgcaggtattttaacagaggacctactgggtggcaagcccttagcgtagctttacttacattcctgcctgcataccctctcctccttctttacagtgggggctggtttacacagcatctaagaatatttccttctggccagtattaacttttataaaagaacaaattataatgataaagaaaaaccaacccaatcccaataatcctgtcgcaaaaggaggttgaactagaaactcaaatccccatataaagtttacagtggctattaaactttcaagagtgaaagaagaaggcaattaaaattattctctcttcaggagaggttgctgcttttcatcaaatcattttatgcaataaacatgaatttgtttaaaaagttaacatttcttcttaatatgcaacttagcagaccatgaaaagctttttttcctctcctaaaaagcaggtaatgaaaattctcagtgatgaataaattattttaacgatataaatggaaacttaaatggttaaaagctctgtccaagattaagcagccagttaaatcattttagtaaggtaatttagacagagtaagatttcagaaatgtagttctatattcctatgttaagggtcaagctcatgctgaacagaaaaaaaaaagtataaatatgacatttactaatgaggaaaggataagctagttagaaaaaggtataaatttaacaaaaagttaatggcaatacagtagcttagaatacaggtttcttaggtttgcttaatcactctcaaactgaacacaaaaaatagataatactatttataatattctcatttttataatagaattttccaaatgtggttaaattgtggtttatttcagtataagaaatttcatgattgtataccaattaataacttttaagcaaaggtaaattttagcctggtctatagctgaatgattaaggaaaatatttctttaatcaagaccaaaatcgggcagtttttctatggtagttaattctagacagaatttttttttcttttgaggggtcagaacttaccaataacaataaaacattctattccctgagataacagctccttctttccagataaatcaaccccagtttcaggaaaaataaagcatcctaggcccattgtagaggagggaaaagctgagagagatgctgggagccacgtatccatttcactgtgttatgtgataatcacctatccagagttctttatgcagaggagggaggaagtctacacatattcttggaaatgaatgattttagtttgctaatcatgaatttaagtctgacaccgttaacctaacaagtcaaaagtattggctttaagccataaaaattccacatactatttagatttttttcaatacttaagacccctaaaaataaaatgagtagagaaagagcatgaagactgaacacagtaggtacaaccactcacttcatgaataactcaccaaaggaaggattcctttagggacctgaaggatcttggagaaaaacctctcttcttctcaccagcatacaacttgacacttccatgagattactcccccacccccatgcctgaactgtacacatatcaccttttcactaccttccctaatgagaatcttaaaacatttttgtaatattcacactttatttaccatgtcaacactggggatactgtgggcaggcttaacccaaaatagctgcctcccatgcagtacagggatgatgtcatttcaccagcaaggtatgcctctgggacatctccttaaccaggaaaaaaagtgacctttaggacaagagaacaagtatctcgagactttaacctgtatctgctactacttaaacaaacagcatcctactatgagacggatacgttgttttcaatttctatgccatgtttttttataagcaaaggctggtgaaccacgttgaactctgaatgctaaacgatcgcccagcatgctcaagaaaaaacattaatattttggttaacagaatgaaccacaggaggattattaaggtaaaatgctagaagacaaactgaactttgcacacacaaataccaaatgtatagagaaccgccaaacatctttggtgattcccaagtgctaggccttagacttgctgtcataaattacctgggaagcataataaaaaacagaacccggaatctcacctgtggacagggatcgagtagatctacagtggatcccagaaactgtatttctaactcacttcccttgggattaagatgcaaccaaagtttgggaacaaatgctttaggtcctcacagagcctgagggacttcacttcactcaccatggaaatactgaacatctgtcatttattcaacacaccaactactgcacaaaaccctactgagctaatgctattagggagccccaggagaaactgctaaataaaccacctttcacagcacttgattcactgtttcaatatcccaataaccaggaattttaccaaacgcatactaaattctaagtggcttggagtacacaaacacttgtatatactaaccaatcttctgtacctttctaaagtaaagcacagtgtcctggcaagagttttgatataacgatcagaagacaaggatttgtttgagtcgcagctctttcttcaactgcctggtcttggctaaattgtatgaccaccaagatctccactctgactgtggacagagaacagtgcttaagcctaaattacatatgggtccccctgtaattccaaaacttctgtggttcctcaagggtaaagaatatagacttcaaagaagggggaactcagcaggagctggaacaacctggaaagacagaagctgaaggacagaattcctttagatgggctccaaaagatgagatgaccacagttaaactaaaaatgagtgtgaaagggtataccaaaaagtcggagctgcaaaagcatatgcatggacgctgggagtaagatcagcttacaagtaaagagccagtctgagaacagtggagaacggcaatagcactggcatcactcctacaaaactcagccagatgatagggtaaaacagtagagaaacaccatagagttttgagtgagcagtaacacgagtaaagtggtgctgtgtaagaaagtggtgctgacagccatcaccagtatagattagacgagggaaaaagacttatttatggaatagtatcccaggaaatgaaaaggcttaactcaacttccaaaacattcttaaagctgtgaatactagaaaaacttggctcaagacattgtacaagagcacaaaatctgtctaatggaaataaataaacatagaaagaacaaacaggcaaagggggtgctatatacttgtgggaaatggtctgctttgcctcttagacaaatgtgggccaaattgaggatgccagctgttatctgatatttttacaggaaccaaataggggcggggaaagaagtagcctgctatttgcccattaccctgacccacatctcagaaaatcagaaactgatgtcacactataaaagccacaaagctttactgtgctttcttccacatattcagcccaagcagctgggccctaaagagaaaaggctggatgatgaacagtaaggaagcagctgtcatcaactgtctccttgaaggccacgggcatttctcctgtggagacctatttcccctgcatttctaccttcttctggatcttcgtgcaggaggatatttagtaaaagaactgacacactagaatgaaataagggtaattatttctagaatggagaaaaggatagttcctgggacaagccatcttgaccacctattccattttcttcccaactacaactcaggacctcagaactaggacaaattagcagcaacgctggaaatcaatataaattgaggaaaagaaacctgcaaaaatctgctgtaggataaagagcacacggtctgacggtaactgaacactggatgtctttttaaagaacacttattgttacttaatagtactagtaaaagatctctgacacagaaagtatgcagagaaatatagataacgagaaaaagcagttcagactgaaaaaacttcaaaacaaacttgtcttacactttattggaaatctcatttttcccttcacattttgataatatacagtaaccagttcattttctgattggtgaatcttttcatagaacagtttcttgctcaagaagtatctagaattcttggacctctcataccctagtatatttgggaaccactatatactttcatttagataagacagggctggtaggcatttttcttaggggccaataaatataaagactgatgtgtcaaaaccactcagggctaataaattaccttaactggtaattctaagaaaagcaactttaaagcacaaaaatgacacttcatttccagatacctgaaaaaaatgagcaaaaatcttttacacaagtctctaagcaagatggatactacagtcagccttgactaacttcccctcaccacttcaggctatagtctgagctggtttcttaaatcaagggtggaaaataggttcaaacttgagtcaattgatagaagttgtctggaacactattttgaaaaaaatatttgggagccacatctagactctgtgagaaagagtgccatgattgactggcaatgtctgcactgggcaggagagggcaaattgatggtacagctaactaagaatttgctagaggcgacatccctcttattttctaaaggaaaagaaatctatgctgtgaattagattagctccctctcaagagagaatctacataagaatttcaaagattcacaaaagcagcaaagtatgtacaaagttatttactgtacgtcttaaaaagaaaaacaacagaaaaaataacctgtgtcatgtaagttcctccagtcagtctcctcaaagcaagctgaattagctagagcaaactacaactcaagcaccacatctagcctgccacctttttgtataacccatgagctaagaatggtttttacattttttaacttggaaaaaataaaaagaatatttgtaatacataaacatcttatcaatctcaagtttcattgcccataaataaagttttattggataacggctgcatccatttgtttatgtagtggctattactgctttcatactataaaggcagagttgagaagttgtgacagaatgcatggctcgcaaaaccttgcttattcactacccagacctttatagaagaacaagtctaaggtttcctcaagttatagggcaagtaattctctataagggaaggagacttgattccgtaggcttcctataacatttatctaagagagttgttgctctgtccccctttgcgaatacatgaatgattatacatagcactcttgaacaaacagtttcttccatcttgcaacaaacaccaaaattccactatgtctcccaggtaactgtttatatgggcccaaaaggaagaaaggaaagaactacaaataaatcttaatttttttaaacttctgttccgcaagtagatataaaaaaactttaaacatacttttattgttttggtttgaagtctcaatccattcagggtgttgatagctttctctgcatccttggggtcaatgtagttcacaaagccatatcccaagctctgccctaatgaaaaggaaggggaaaaaggcatatattagttctatactgttgacagagatcaactttcattttggcatatggtcttgtcattaacaccagcatatttcctcaacagtaaaaagaactctctattaattctagaaatatacatgaagtctttatgtctcctgtctactacattttcaagttttagaactcagcaagcagtgctgtttaggaaaaaaaaaacacacatccccaaaggattccaccatccatgccctgcctgagccagagtataccatcagcaagacaaggtcagcttcataaactgtggggataaatctctgtgctatggagagggcttaacaggcaataccttttcagcttcagtttccttagccataaaaatgggaagacagaaaacatcaaccaagaatctgtcagtgttcagtaaattgtaccctgacatatttacagcctttaccaagtacaataatgtcggagtctaaaatggtgaagaaccatgtgtgggcgtgtatacatgtaagtttattttagacgagggcttatcttcaaatacactcaatcaaatttctccaaagagggttttatgatctagataagaacaggaaaatatgaacacaaaagacttacagggatgacatcgaagacaatgagaacatataggaaaagaagaaatagaacataaacaaaaataacaggagaaaaaaagtctagagtaaaagttgcttctaagtgtttgttgttgttgccaccctccccccatcatctgagccctctcactcctggttcactgatgccctagatctcagacaatgggagctatcaaaagcagttgcatcaatggaatgcaaagataactaaagtcaatcgcaatggtctcaacttttcaatgaagcaagtttctcagtttgaaatggcaagaaacattatacaggtgacaaaaatggcataagaaaagtttagtctacaaaagtcaaaacaaactaaatgacgatttcccagatgcccaaggacggtccaaatgcttttactaagtactactgttgcatcaatttcatagggaagtgaggtattttttcttgatggggcaccgtaggtgcaagtggttatcaatgtgggtttttaggacagctactctggttatcctaatgtggatacttgttaccacataaacgaaaagagaaggctaaatacagtgcccaatatgaaaactagtgattatattttgggaccacaatcagaattttggataatcactgctaatatatgtcctctatcaaaatgtattttttcctttttaaaaaagagaaaggaatagagagctaaaaactaattaggttaatttcatctcacactaaaattgaggttttattttacagttctagtaaagagtcacatgtgaagccactgtatttttaagcattcagcttttcattaattcaaaatttatcatgtgtttactgcatgcattgtgcccctcttatgaaaatgtgttgcagtcctattgtcattgagtagaattaaattggctgaatgtaacaaaatctgctcaaggaaccagcttatagtggaaagacagacttccaataccggctctggtgtttactggctcgcagttagctgtgcaactttgaagaagctacttaacacctctctgaaccacagcttccttctctctaaaacgagggtaattcctacccaactaggttgctgatgcaatgatgaaaatattcattaatgatgaaagtggatcgtcaccctagtcaaaagataacatgagaaaaaataacatgcttactgttaaagattttaagtatattcatttaaagttaaataaaaaagatgccacaaatataacagaaaaagaaaagggcaatacaaatatagttttgtcatactgctattctatgacaaaataaatcaattgtatcagcatagtctaattgccctttctactgatagatactcctcctcctgcatcttagcagcttctaaccccagtgcattctcaaacttgactgcaatggaatcatctagaaagcttaaaaaaaaaaaaaaaaaaaactaaaacaaaaaaacctgatccccgaatcccactcccaaaaatagatagatatatatacatatatgtgtgtttgtgtctgtatatatatgtgtatatgagatgagatctcactacattggctgggccatgcttgaactcctggactcaagcgatcctcccaccttgggctctgattttatcagtctgtcatgaagcattggtactagctttttaaaatcctggtgactaacgtacaaccaccatgttgagaaatcactgccttaatggtgagaacctagctggggctacaacggggctgctgggaggtctaagaaaggtcttgcagggatgactgctgtttcacagttgcgttgtttaggtacacgtggatgtgtttcttctaaaatcttcaagttacctattacttcaaagaaacagtttattggcctcctgaggtctgtctggggcacaagagtgcctactgagattagatcactgggtaaagtgaaaagcctgtcttgcttacttcctacttagctgtttcccactctagcctctgaacccttactcctggcctgctgtaggcatggaaacatttgctaaatgaaagaatgagaaacttactgatgttatttatttaaccaaaggtattatcatcatcaccaccaccaccatcagaagacccaaccatcaaatgggtcttccacctgataccctcaagcaatcatgactagctatatgagtcagtcaaatatctagtatctgttaagttgtttatactcagaaatatttatccccaaatgactttgcctccttataaaaagtttcttatttgcctagtggcattattaggatgagtgccactcagaatatgtttgaggtaagcaaaactgtattattatcctaagcaaaataatatgaaagggggtatctgctattaaaagactgcattcctaaacctaccatcgttggtgtattaaaatgttggcactataacaaaagggagttagaactttaaattactttacagtgaaaatctgtaatcaaggcagcaaatatttattggatgtttaaaatatattaagggtatcgcagatgataccaagataggcaagcctccccattctcaccttttagctacatggtattttactgtttaattgtagcttcacattaaccatgttcggtattcagattcttctcctacaaggtagaaatgatatctgaagcttggcaaggtcaatcagcttctacaaatcaaaaaggcagggaggaagtagtaaagtcaggacttgaagtcaggactttcaaatgctgtgctctactccactcaattaactagtttatacctgaactgagacttcaggcatattgcgtataagcccaggactagtttgtacccaatatgcctgaataataacgtaaccaggcacttctgacacttttaccgcaaaagttgtttcttgtttgattactatctcaaacttctgtaccttttatacaaatatcagttttactatatatgaatttcagtgccattattcattcctatgacaacataaattgcatcttatttatatagtgcatatttctggttataaatgagcgcacagtttttaaaaataaaagcagtagcaaggcaaacattacaaaaaaaaataccttacctacccttttcccactcttatattcatcagtaagtcatgggccaccagggaaggcttggaaaccaagcatcacttatccatatcatccaaacctatttttcaagtctctctgaatttagaatgtgcatactgataatccccaaactaagattcatttctttaaaaagttttataagatgctacatttaaattccaagtacaaccattatggaaaccaacatgattaaaagactattctgaccaaaatgacaaagctaaggctcttcaaaaaaaaaaaaaaaaaaaaaagcccttaagaaaaacaaatcctgtctttaaatgccaaaaaatttgcctggtaactgaacataaagaagaggctcaatgccacgtgtcctcagctattctcagaagctacctgtggtcaagtgttctaagaattttcaaaccattaattcaaatctttcttcttttgaggcaaggtctctctctctgtcatccagactggatggcagtgggcatgatctcggatcactgcaacttccacctcctgggttcaagcgattcttctgcctcggcctcccaagtagctgggattacaggcatgcatcaccacacccagctatttttttgtatttttagtagagacagggtttcgccacgttggccaggctcgtctcgaactcctggcttcaactgatctgccaacctcggcctcccaatgtgctgggattacaggcgtgagccaccgtacctggcccaaagtcttgattttaatggccttggtagggattctagaacttttgctatattctgtgctgcactgttgtgtatgaatgccttttgtttcacacgcttctttttaatctaacatacatgccacagaaaagaaacccttcttcacaagagatagaaaaatagtttataagatgctcctggcacaaggagaacagttataaacaggctggtagaaatcatggtcaagggatctataccacagagctgaagcactccagaggcctctgaagaggaccaaagactactgagagcagggttcagagcaaggagaggaaaacaggaagaaaacccgtttagtggcaaagtgctactgtgggaaacacagtaaatggcaatatatcccaaactgtgtgtaattcaaagcatcagctattcccctgccacctacattgttttaataccctactttaattaaaattttaattgcatattttaattaaaaatacacaatcttctggacctgtttcattcaaaggtcactttatttagtcttttctattttaaattactaccaatgttcagaaaaatcaaattaccccctcaggtttaaaggtaaaggcaatagactaccgtaattcttgattaaaagtatattaactttatccaaccaatattaaacaagaccctcaacacaaaattgtggaaaataaaattttgtatttaaaaaaaacaagagtcaccctacaaatttctcatctacaataagcattcaataactatgggaaccatactttttgctaggccctgagaatgcaaaggagaaaaagatctttctcataaagcctatattctgacaggaacacattctacagggtattagaagaaaatagagctaaggagaaaaaagcagcagggggtgagagtggggaggggaggagcagggctgctgtttaaatacaatggtcagagcaggccctatcctgcaggtaacatttgatccaaggcttgaaggaactagctcaagtctaacagtgaagatgtgcaagacgttccagcccaagttctgccacacccgcatcacgttctgccagtcctaccagctaaatcggccccttgtctgcgttagcattggttctctattattctggccctgatcactgctacactatcctaataggacaacccttgcttagactcccattaattccaaaaacagccatcctccaccaaaacattgtccaggagaacttcttaaaacacaaatctaaccatactctggtttccagtcactgtcagttttttgctcacttctactttcgctcatcttccaccactcctacacatacaccctaaaatgcacattcagttctctatgtctggaacacagctctccaactagccaactcccatgtatcctttgagactctctgaagtcatttcctgccacaacttgccccatccccagtgcacactgtacagtgctcctctcgactagtcctcccacagcttcttatattattccgttatctttgttatgtgtgtctggggtccatttggatgctccctcactagactgctgagcaagggcaagcagaacatagttcctgacaaggaggaccctaagacagatcattaaatgttctgtgaatgactgaatgaaaaacaaatgaaggagcagcagcatctgccttccaggagcctgtggtttaggagatagttgcccttataaacatgttcctcatgtccctacattgtaccagatggattacagaacttgtggagacaagatgctcaaatgttatagtaattctgccttcataaggaagtcatacgagttttaaatagttcatgtaaaattgttcatacgaaaaatttctacaaataccattaagatgaagtctcaattttaaaaagtgtcatctagagtaatttgatagatttacataaatctgttccacaaatcggtaagtatgaattatgggatgtcagcatataattttgttgaaagtactttttcactaatataattaagtctgctgagactattcatgtacaagtcaaataaaatgcagagtgaattctgtaaaaacctggtagttgaatcaacaataaaaggtgactacactgattgatgtgtatctattattccatttacagcagtagtaatgttttatgaaataaaagaataaaagccgtgtgaatctttttcaaatcccacagttagcagaaacaggtcactatggtcctctctgtcaaggaagacttgcaacctgaggtttaataatgcaatacttttaaaaagcaaaatggaaagattcgcttcctccaaacacagctcttgcataaaactgcatgccttaacgacaaaaaaaagcaaataatttgatttgcaaaaacaagttttcgttacaaagggggaaaatttttgtttttaataaagaccctgttgcctcctgatatccttctctctcctccctcaaacacacaataaagttgcaaatatattgtatttcttcagatggacttactgttcttgggcactcattatgtgtgtctgttcagacaggctgtgcactgcaactctggcaccaaagcaactcgcaccagacttcacaaaggagctttcttaatatctcagatctgatacacagcaaaaccatgtgggtaccacacagcagggaaaaggtttgagagaatctcagaacagagggatgcagttctctctagtcacgtttttctccacattttaattcctgacttagcctgagtctcctcaaatgtagcatgccagatgcagcaggtccttccatttaaacactcaagttaaggtgggtcaagttaaacaggtcttccttgctgccctctaatgagtaagatcaaattgtgagatggaggactggtgagatcctattactacagtccaagccagccttcctgaaagctgggagcatttctaccagcttcccaaaggacattaccagggattatcacaaggatggagaattcaacctagacactcacataatacagaaaacagatggctcactcgaagactcatcttccacccaaatgctaataaagctggcctgagactgaaaggccccaaagtttctaaatgattttcaggactttacagatacatggagctaatatagaagagtttaaatcataacttttctgctgaaatcaaagctgcaaatagtgatcatttggtaaatattacctaagcagcctaattctagagagagcggttaatgtcctcagcaccagggcattttcccttcaagttaattttaatagccatatctgtcccctgattatgcaactggtagagctctattttcctgtagttccagtcccagtaattatgaatctgctggcaatgcggcatgaccctgcttaagttggcgatactgtgggttcttaatatatcacattttcagacaacattaagaactcccacacaattcagtcttagactattgagaacagaaacagcatattaaatcctctaaattcttgccaagtattacaccgggtacacaaagatatcttgcatccaagaccaggaagatgaggaaaaattatgtgcagtaggaaaataaaccaattcctctacaacccacaggatgagactctacctgaaagcaggttctccagcctgaaagaaagtgactgagatagtgtagcacgctcagcaccacaatgaaaacaaaaggcggttctcatcacttattgatataggtagtttctctaaaagataggtcagcagttctaccttcaaacactggagctgccaccaggatagagcaaatgccaaaataccttcagatagcctgaaagtcatacctgacagttcaaaaaaggttaggacattaacaactctaggctagtccaatctactttcaattaaaagtttgggtatgctgcaactttctcatttctttgttaattataattaattctacacagatccgccaccgcccctacccccacccccacacacactaacagtcttatattatctgctttatcttgtgtttacttaaaagacaatggagttgttcaagtatataccatttgggatgaaggcaaaggaactgtattcctcaaaatagtattgtggtagaggaaaacaagttaactgtggtagtaaaaagggcatctgctgttgcttgtgcgaccagctggtgtcaatcttcacaaacatgcactcttgcctgtgcctgcacacacacacgcacacaccccccccactaagcagtccatcaagaggcagtacagcttcttaatgtgtttttctctctgtacaagatcattttttaactcagataccacaagaaacaaaaaatttaaaggccctgttttgaaactatgtcagagtccctgcaaaccaccatggagagctccccattttgtcaagaacgggaaactataaaattagactctaacaaactcaccaagtccatgtgaaacaaaaattctcgttagagataaattttcttcttgaacacatttttcttaaaaaaatcactctctcacccaaaagttaaaggttcaccagcccaaaccttccagtatgaaaaagtcagtaagtttgtcggggaaaaatgcccattcccactgccccataaatgctatgtctacctgtctggcagtcaacagtaccactgccaaactaaactatcaagcaactaggatccttacattacatatatcacatttaattctcaccacaaggctacatgtaaatacatctgtatccattttacggacataaagttggaggttcaaagatgctaagttaacttgctcaagggcacacacagctagctcaaaggagcagctgggtttccacactacaatcaacctttccaaactcagtctttcaaaagtgtacactttgttgcctttggccatgtgtggaaattactttgtggcagaatcctgtacatccaaagtttacaactttccaatcagaatatttataatctccaaatacatctgtatttttttcttgttctttgtcatgaaataaattgactggaacttcaattctttcttaatccatccaagagactatctgtgaaagaaaaaaaaaatgacctgaaagaaaaggaaggacatcctgcaggtgcacaaaccacttaagcccccaaaacaaatccatcattacaaaacagatagatgagaggtatctgcattataaaaagatccatttaaaatgggccttgatttacatactccttttccaaactcagaaagcagttcttatggctaaagccaaacatgtttgctactgccaaaacggtctcccacacaagacatttctctcctcagcagattgcattaaaatgctttcatacgcatagcatgatttcatagcggtggaaaaaagatgggatcaataccacatggtctctgccctctaagatgctcaaaaattttaagcccaacacagtaaacaagggagagaggcaggcacctaatgaacatgaaatacataaagtgcatcgcaggggtttcaggcttaaccaggaccagcttgaaaaagagaactctttagtgtgtcaaaacagagaagatgaaattcaggtgtttcctgacaaacaaattaaggtaataggaacatggagaagaacaaatttgtaaagaagtataaaagagacaagccaaaagcatactacgctgaacgtaaggcatctatgtagaggtaagcaaaccgaccccccatcctggaagcaagactggcccatgtgaaggtttacagcagacaaactgcaggatgcaccaagcactgaggcacaatgaggaaggaggcacacgagggacccagggacagtcaccttagtggcctggtataatcactgagcagatgcagatgtaagactgtaactagggacctcagtgttagaaatcacccacattctttttccttcttccctcccctctcaactctttattccttccctctctagacactcccccttaggcaatccatgcttatctacttaggctcttaagaaatcccacaggctaatcttgaaacaaaccaggaacagagtccccactgcaaaatcctcatgattaggaggagtcataattagtccaccaccactgagccaaagtcaagataatgccaattagaccttcagacacctgagagagccactgaacaagacacacagatcctgcaccacttctgcacgtctcccatacctttctccctttgaaagccctacggtaaatttttaaattgaagatggtactttagaatactagtttgccatcttctcagtttgctggctcccattaaaaatgcttttccttccaccaatccttgcctcttgtgttctggctttcaagtggcaagcagctgaacctgggttcggttacaggccttctagagtaatggccaggattgaaacctagcaactccttgtgtcccaggaggatccatacttccttggcatgataacatctggcctttgtaaaagtaactagaagggcaagaaaccttttgaaccataatacccagagattaatacaacacaccaactcagcagccttgaaagtattcttgcactataaaactaacagatatggataaccccaaccaccaaaaagctaaacccaagatgactacatcaggcagggcttacgattttctgagacctcctttacacagctgtaaaaacaagtacctcaatcctctttctgccccccgaccaagctaagctgctattatgagtggacaaagtgttaataactaccacagtaaatggggaaaaactactgcaagtgttaacaaaccttatttttaactgagtagcaactgcaaaattacacatgccttgtgaatgcacgtacatacctacgtccttcgcatacaatatggtgacatcaagttagaaaaggagtgaaagagggagggaagctgagtcattaagaagggaatattgggtagcatcacatgatcaggtgtttcaataaaaacatatttcaccttatgtgtactgatcataaagtatctgctatagaccgatatgtacaacccttccaccggggggaaaatgtccactgtaattccttttatatcaaaaagaaagagcagaattaaattagaggtatttttagcaaagacaaaggaagtaaatttccaaaggacatccatcgtccccagtcgacacaaggattaagtataaataacgtgatttttcttctctttgtacaggacatgttgcttagtttatagttaatgaagaggtagttaatcaagagggtaggaggaacatttttctttctttcctctaaacttaaaatagtcacacacagcactgatttttacatgcttaggaaaaattccaaaacagactgatggtgtttgggctggtgggggtataaatgctgagtataaaggaaacctatttaaatactacagacacagcttcacaaacctcaagaacactctctctgaagcaataaagaaaaggaatcctaatggaacacagtccccagaggaaattgagctgtacatggttaaagttgtaaaggctatgggtcagatgggaaccatggctacgaattaagtcaaagaggtaccctgacagaaataagtatcaattttgtttttgctcagggacagcttatgctacagcaaaccactctgagaccacagggcaacttgcccaccaattaacagatggctcctaaagagaagtacaaaatggtgcagctcctacgattgccacattcatatcacacataagcatttcttcccaaatcacctcatccaaaagttgaagtgattagctattgtaatcctccaaatttaaaattcacggatactttgaggaagattttgctaaaaagattttacctagacaatgattcattaggacacaaaagtaatgtggcaccatccacatcagcatggtatagtaaacgcattatcctgccgaatgagcagagcacagaggcttgtcttgtcttttaccactgactttaaagtatattaaaaacgaactatctaaatcatatacccagcaacttagtacatctgaccattgctgctaattctggatacatctttcctatgaaacaggaaaaacctaaacacaaaaataattttaacatattaccattttatcatctcaagtactcttaaatgtataacagggtagagggttaaaaaaatcttattcaacaacacttcaattttaattcatcttaaaaacttttaatgtgatgctttctttaatctgctgttactgaagttactcgatttgcttattcacatatctgagacccactcttggggaaggcgctatgtttttatggcaccagattaaacaatatgaaggaccatctgatgtgggaagtaacttctatacacagagcttctcagctatttgggccacattacatgcccacttggcaaacacattttaagattaaggctaagacaagtggatcagaagaatccatcttattaccacaaaggggtccctaaggaaaaggaggttaggagtttaaggcctccagctaactagccttatgaatttgagattgggatctcatctgtgggaaaagaaactgcactaaaggtactctctgatgctcgcccccacctattattctaccgtctccaccttaagtttcacaaatagattctgatgtgcgtgttagaatcactcttgttaaaagaggttcctacaatgtagaatgccatacaaaatgttaggtattcaattacaagtacaccactcgaagaaatgaatgttttactaaataactagtttttcagctcattccaatattcaatagcctatgctgtcaagagttttcctattttgttgctgaaaacttcttccttgctatttctaatgaaggaataaaatagttatatattataaactaatctcctttattcagggaaaaactttaaatatgtatgctgccagatcacttactagcccctgtacccaaacagaatataacctattaagtgcttattctagttatcctaattgacaacaacattattaaggattctacttagattataaactttatttttctcaagcaagagtactttctagcaagaaaacatatatatactgaaatggatcttaacacaaaagcctactatactattttgggcttctttatccttctcgcgcaccccccacgaaaaaaaataaaaataaaaataataattaaatctaatagtaaaggaattagaacttttacctcattattccctacaaagctaatttgttccttcatttgcactctctgtcattgtaatctatgacttaaagaaaatgaagcaaaaaaattcttttaaaaataaacaaaccaaaaaaacaggctgggcacagtggctcccaaataccagcacttcgggagtctgaggctagaggatcacttaagctcaggagctcaagactagcctaggcaacaatagggagaacctgtctctacaaaatatataaattagctgggcataatggcacatgtctgcggtcccagctactcgggaggccaaggtgggaagatcacttgagcttgggagcttgaggcttcagtgagctgtgatcacaccaccacactccatcctgggcagtgacagagcaagactctgtctcaagaaacaaataaaatacaaatcaaataaccaggaactatggtagatttttacaatccccaaagaagaatgttttctgaatgtataatctacagccaaattaagatattatacaaagattttctgtgtaatcctctataacctggtattatcttggccaggtcattcccctgccctacccaccaccatcttttcactttaagctacctgaacagatatcccattcaaatcctttaggtgtacacaaacatcttaataggttgcaaagaagaacacaaaattgactagattcttttttgaacaattacatttacaattcaccatcaatgacttacttgctgggaaaaaaaacatactgtaataaaggtaaaactagacttgcatcttttcaaggagaaccaaagactgtccaaaaacctaatgatgacatatactacttatcccataggacacagaaatataatgcctgtaagcatacacatgtccctacatggctggaaaccaaaagcgttaactgaagggttttaaagaaatgaccactaaataagcagaggagataaatgtaggtcattcagaggcaaatctgttttaccacaagatatatggctctccttagctactaaaagcaatgggagtcaccaaacattactgacctctgaagactaaaagctagagatgaaacattcaaaaagacctgctgtgtgaatgctactgctagtagtcatctcagtcattcttcaggttgttcttgctcacactcagtgagcaaagtagtgcccaagaaacataatcaaaagggggaggaagtcacaagagatgacttggaagggaggatcggtatcttcactgcacctactattttcaaaattaaattcaaactttgctttcctccaacactaacaaagtgacacaaatatgagtaaattgtttgaaaggcactgacaagtgactttatttacaaaatatgcatacatacatacacacctctcaaaacaaactcctttaccaatagctatggcaagttcacaacaggggcttctaaccaattacaaaagttattctcttataggtcaaattgagaccaatacaaaattaataagcttacttttgagttaaaaaacactgatagaaaaagataaaaaatatgaattacataaatattgtttcaatggagttctagattgtacactgactctacctaactggcacaaagaaacacactggaagagtcacagagcgttttcagaatgagtaagggctgggaaccagacttcaaggagttaagtagtaggaagtaaaactacccccacctcagaacagagaggtgagtcatcatcaccatcttatccttctatcacttccttgagaccctaggtcctgagataaaatgcctaattgactttacttcggttccttactggctgcttgcctataggcaggcagaaagagagaggacccacccaactggcttctggaattagctttttcccatcagcaatatactaagaaagagaattccccaatacagaaggaccctaatgaaatgtaagactgagacaagtttgtcttggatccacgaacatccttagaagtctttccatgtaaactgaaaaagaaaaaaaaaaaaaaaagcctctctcatttctgttcaaataaatgactgcatccaatattaatcatcaaatgaaataatcaacaaatcattagtggaccagactatactttacatcttcgctcaacaaaacaagcaccaatttagaacatcctgcattccaccttcacagtatgacaattccctccttctctacctcccttgaaccatgaggtataccacaagaagttccactagccgagtacagtagtcctccaccccctaccttatccttgggggttacaagaccctcagtggataactgaaaccacagatagtactgaatccaacataatatacactacttttttttttccgatctgttaagatggattctaagtgattaaaggacagggaacatgtaccagccatggataatgtggacaaagggatgattcacatcctgggcaggaaggtgcaaaatttaatcacgatactctgaatggtgagcaactcaaaacttatggattgtttatttctgggattttccatttaatattttaacactatggttgaccaccagttaactaaactgcagaaagcgaaactgttgataatgggaggactacggtatttcatggcacaggctctcttcaacagatagtcaccacttgaaatcaagaacttaacactggctgatattctccagcacacccaaagctcagacaaagactactgaacaactggttaagcttgagtcatctttaatcaagacaagaccttacagctccagaggtagaagaccttcctcatctcaatcagaggcttttggaaactccctacaaacatgagtgcaaagtaggcagtggggataagtctacacaaagcttgcattaagacttacccatgaagtattcacctttttcattattttaaactcttacaacccaggggaggctttctgttaagccccaacacaggaaattgcttttcagttgtcaatagccaacgtctgaaaataaatccagtcactaagtgtggaatgatgtacttgcagccaacatgcatttggctgatgccaacagagaaggcaggaggccaagatataagacctaaatttttttttttaaaaaaaggactgttctactcagtaacagaatctgaaataatgcaaaggcagaaataggccacaaaccacctgcctctctagcttcaacatacatcagcatctgtctcccaaggttgcttcagaaagatatttaagttttctctaactacaataattgttccagtggtctaaaaaaaagaaatggctctgtcctgtgggtttctggttgggtggttgactgttatattgatggggggcttccttgaggggtagggggaaagagtactagggaagggggagaaaaaaatggaagaactaaaactacagaagagaatttctaactcgtcgctctttgactctgattgaggaatggctttctgccaagatttccttcaagtgctcagcagagaatgaagtgaggtaacgagaagtagtctggggatgttacacactgtgtcctgtgtcccaagaccccacacggatgtttgtccctggatgctctgactctctgggagaaaagagtagaaaagtatgaaggcagagaagacttccagggagcaaaactacttgggttcttctttctgacccactgtacatacaccaactgcctcttcctccaggtaacttgccaagatggggagtgataagagattgaaggcaattttcaaaagaataaaacaagcttgaaaccaggcagaacaactgcaaagggggtaagatgaagtccctgcaagtagtcagcaatctggcaaaatattgcacaaattcagtattttaattggacgtttcttttacggggaatgtggcatgaactaaatttgaagccaggctacttatttcagggggaggggttggtccctaaagccacttggagaggaagagaaataaaacatacagaagagtctacagcccaaggggaaaaaaactagtatctcctgaaaacaattatcataatttactttcaaaatactttggtatatcaaatgttgtatgatttcatttatatggggtaccgagaataggcaaattcatagagacacagaaaatataatggttaccaaaggctgggagcaaaggaggtgggtgaggagttactgtttgatggttacagagtttctatctgggatgatgacaaggtactggaaatggataagggtgacggctgcataatactgtgaatgtgcttaatgtcactgaactgtaaacttgaaaaggttcaaatgataaattttatgttatattttgccacaataaaaacatttctttttaaagtttagaattaatctgatgacacgtgtgcaccagccatttaagctttaattctgggtggtcatctaacatactatcattaatgcacaatccaggattagttaactagtataatacaagtaggctaaaattcaagtgactagtgtaagcctacatactatccatacctaaatcaacaaccaattctctgctgattcacctaatggatgtcaaaatagggttttgttctgtaagccagttatttgttaattagcataacgagtgttagaaatggagtcttaccggtaaaattaaaggagttcaagatacgcagatgggctaaattagtttagagacacttcccaccttcgtataaacagggcacaaaatccaaggtggcataatccaaggtggttatatctttatggagagaacccctaaatgttaaatggtcctgggtttcagtctttgtttaaagggatttctttttgcatgatgcaaagtgagggtgcagaacgtgacttttgggatattgttagcctccggtgaacatttcatttaaagtgtgttcaaagcacttaaaaaagaagagagaagtgggactttaccaagctttcagaaaaggcttctccatcaatttggtcctgcttgctagatagaggtttctatgtgtggtgggatctggcctgagaccttctttcattataatctatagagcaactaacgctcacccttcctcctttggtgcctactaacaactacgcaaaattacctaagagctgttattcactatactaacaggtccatttaataaacccagtctcaaggagtcactggtcatgaacacagtggcctccaagggtactgtcttaaaaaaggaaaaaaaaaaaaaagactctttaaaagtcggttgtccaactataaaggctaggaaagaatattagacatcctccttactttgatggctatatccaaatatattgttttctataagcattcagagaactaaaatatcaaatagagtaagaaactaaccccagaagattccatattctacttttaagtagcacatcaggactagctttgtatgttctagagctggggatataatggaatgttatcacgcctttttgcaaaggctcccaatttccagcacttaaaaaaatacacatattgatataaaacacagtaacaaatcggtattaacaattctgtattttaatcctattccaatatgtataaaagggcttacccccataaaaaaaggacaacaaataataaagaatataaaggtctaaaaacaaacctggtataacattgttagattttaagatattagatcccaaatcattctacttgagaaggtagtacactgtctgcaccatataatggcaaaatcacttggcaccatgtttaaaaagagctaacctaatactcaggttcacaaaagaaaaaaaagacaattttagaggcaggatttgggaagtcatttaggagagcccttgtctacatgagaagatgtcaattgatttgatacaccatcagtctctcatttatattcaaaatgtttagatacatttaaagtagaataagagcaaactacaattcatttaaatggaatgaaaaaagctcccatggcttacttagtaccagggttaggaaaaaggattcgtacgacagtacccttggaggcaactccttaagactggatttaaagcattaaaatgtgaggaaataaaactgttctctcaggctccagtgaccttaaaaacagtgcagtgattctgatttaccagtttacacacagctatgcctcccttaaactttactttaaaaggaggatttgactttctcagtattaagtccaaaggtcaaacaggttgtaaagagtcaagggccccatcagatctactctacaaggtaataaacattcaagtctatcatccctcaccaagaaatgcaaatttttgttgagctagaggatgggagttgggggtggtggatacaggacttgtacgccatacacattttccctacaaaatcaaagcagtatgtacaaaacagagttccaacaaaaagtacaatgatgagaaaagaactcattaagagctaaaaataaactctaattcacaatatgcataaggatttaacaaaaaaggaaaacaagatgtaaaattgcatctgctaagttaaccataccctcatggaaactgccccctcccccatacacacaaactgaaatctgtaaagtctgtgatgactgaatgaagaaatgctttagatgttttcaatgaatatttcaatggaaaagaaaacaaagggatagtaatttttttcctcagccttctgatctgctaacactgcaggaatattaggtttttgaacatcccaaaacacaggtctctgtatatctagacttgaacatcatctttgataaaatgagactatttagtatagtatttacgttttatattaaacggatactcatcttaaggaagatgatgtcaataaaagtaaaaataagccgcagttggtttttatctaaccaacacttcatggctcaatttaacaacttgctgaccttcgaaagcccagtaatagctcactggaaagctcacttgagagcaccttcatattttaagtcaagctaattcattctgaaacattcacacaataccacatagagcaataattccacactccggtgctctagttcataaaggctggtgtaatatcattaatcatcattctgggctcccaagtcctgcctcgcactttctattcttactttgttccacccctggaaaatcaattatgttggtcaaatcacctagaaagcaaaggatggaggatgagctttgcattcttcccacatcatgacaaactccaagaaatctaggacaacagatctacttcaagatgtttttcaaaaactactttttacctatggggggaaaaacaaaagtctgcaactgtcacgtaactgaatgggtattaactggtaagaagaggacaggaaagagagacagtacccctgtgtgctaggtactttatgaaagaaactgacgttcagagtcaaaaagcacacacaggacacaacacaaattgagtggctaggctggaattggaacccaagtgtaacaatgttctaagctaaaagctctaagattagtgtccagtaggccacctccctagcaggaggaagcaaaggtattttgattcaaacttaatcccaagaacttgatcccaaactaagtaacaaacctagtgtacacaggggtttagtaaatcctactaccacttaagaaacttttttttgttttttttttttgagatagagtctccctctgtcatccaggctggagtgcagtggctcactgcaacctccgcctcccgggttgaagcgattctcctgtctcagcctcctgaagagctgggattacaggcacccagcaccaagtctagctaatttttgtatttttagtagagacggggtttcaccatgttggccaggctggccttgatctcctgatgtcagatgatctgcccaccttggcctcccaaagtgctggaattacaggcatgagccaccatacccagccaaggaactcttataaacacagcttaaatacttctgtcttgcttttttcccccttaaaggaggcataaggtaaatctttgttctaatttagaacaatacagaatgatcacccctcgattacataaagatgatatatggtgtcagaaattactgagtggagtctgaaaagatggttttaactgcgaatctgtttcttcacaacacttagagcagcaaatgctactctgtgatttacagcccctcaaaaaatatttgattacatttcccaacaccaataaaaggggcatccaagggttttgaaatattgacaatctaaaactttaaagagccaaaacaaataccttaaggactaaaacatgctaattaagccactgtatagacctgacaaatcgaatgacactcaaataaaatgccagaaaatatctgttaaagttgaccttttgagctggaaaagcacactctgagggtttccacagctctcaacgttcagtagcagcagtgtactcagctgaaagtcaattaacttagaacaagctcaaaagaagttggcaaattttgaagcacagttttagctccaataatcaactattctgttcaggaatatttgaaaggaaatgttccaacaggtacagaataaaagtgcttcggtctattctgaatttaaacaaagttaaaaaaaaaataaaaggctggtggccaaagctgtgtcatagttaaggtagtgaaatagaatgaaaactgtcaaaaacaggttgattttgtactacatcataaaaatggggggtataaatcattttcataccaaagaaacagaattttaaaattctataaactacaaaaaaaagaagcaacaagttcatatcacaatttaactgttttttatcttctaactgaactatttccattttagttcaccatcttcctcatcgacattttccatcattcctacgacaagcgcttaaattgagaatggtgtctcttctataccaccaatctcctgatgcaaagtaaacaaagactaccccccagaaaaggtctggaatagcaaacagcacacgtgcactcttatgctgaattataaaggggcaaatgttacaagagaatttcaactgtaattttattttctatgaatttgaatatgtttacaaagtttgtgttttctatcaaaccagcaaagcaacaaagagaaaggttactgaagactattcctaatctactggtaaggcaaatacggctattctaaaagttcctctgataagggctaggaaagcacaaaatcaaaactcctaaacctcatttacaccataggttcaactttattttcccagtaaacactctaagacagctgttggaaaactgtataactgtctcgtgggagtgacacatatttttttttacattttattctaacggaacaaaataccaagtaacacaaatatcaatatcaggaaatcagagaaacaaatctggatgattaatgaattactagagaagaatattgtttcatacttttctgtatcctcaaatagatgtttcttcatcctagcaactagccattaaaggcttcattaccacaggttatctaaagaagcagctctttgatttatgaagagatgttaactgggaattaacttactgaatggtgaaaaggtccagatttgccaccccaaaatattccactttggcattaagttttttttttttattatttttttgtgaaatggagtcttgctctgtcacacaggctgaaatgcaagtgcggtggcacgatctcagttcactgcaacctctgcctcctgggttcaagcaattctcccacctcagccttgtgagtacctgggactacaggcgtgcagcaccaccacacctggctaatttttctattttcagtacaatcagggtttcaccatgttggccatggttggtcttgaattcctgacctccggtgattcgcctgcattggccttccaaagtgctgagaatacaggcatgaatcactgcgcctggctggcatcaagtattattttaggctgaggaaaataagaagtcaacagatgcaagatgagttctctgccctccccttttctccctaaaagcagagtataaatttcccatgggaagatgtctctctgtcctgtaccagttcagaagtaagcgactcattacttgagacagtcaacatcagattgtttatgcatacagttctgtataaaccaaccttgttaaaagtgcccttatcttgtcattacttacccctacatattttctgaacgcttccccatgatttcctattccgcaaagtccaaacctttcctttgttaaaatggtatataagccccccaaccctgaccactttagttttataatacttttctgtcaactcccaaacacaaaatacgagcaaaaattgtgtgccatttctccaattaatttccaagtccccaggtactaaacaaaagaggacagaagttgtttttcctaacaatgataaagaactgtactgtatttgatttcttaaaatgttacaaatttctagtttcatcatcctgtaatctttccactaaactaatcaaggctgacactgaaaattgttctataaaaatacccaggttcaagtaaaaagtgaacctagaagaataaatgttaaagactttctccaaaattttatatgaagcttctacagtgataacaccaaattttttaaatgactgcaagacctttggcaaagaaacaagatataatgaaaaaataattaagtttaaagatacatcaatgaagatataaataaagtttctccattaccttttgcctatgagagatgttccaaaaatagaggttccacaaacttgacacaaatttcattttatacaaacttgggcactaaaatctaaaaatagattcaaatgtactgtattccacagttaacgcactgcggaccaaagcatttacccctgtgcaggcatctcctttcctacagacctaagaacacacacaacctttctgccatctttctaattaaatagcatacagagtttgcaaagtgaggtgtttattaagttaccacccacccaaccaccctgctgtttccaactactggtctgcaagaatcagaattcttgatctcttgatactatggacatttcacatgctcactgtacaactgtaactgacatacaaaatcacattttcaaattaatgttcatcaaaacagctttgtgttcactgtgattgactcataggaaataagtgctattaaatttgaaggttcccattagtctaataaaataccacttatctgtttcaatcctgaggagctaagattgtatttgtttaaaaagaagagaatcctatgccattaaaatagtttggaaatcacattattttgatagaataaagaaggatcaaaactagctgtaaaattctcagcaagcagagacacaagataaacctagctaagaacactcatattaataaaaaatattttaagatactagccctaaggcgtgctggggcatggcaggagccttatcatgcaaggcactacctactcagaggtaatcaacatctctttgggccctctggaatttatatttgggtttttgttttttccccttttgtcaaagtttctagttagcagctgatgaggtcagtacaagacctacctcaaacaactgagagtaatggtgaaatactcattacctgaggtcttccaccaactactcctctagccattcttttagaagaaaggaaaaataacagtgaaagaacaatctaccctggagtttcaaaaacctaattacacttaaacacacacacacacacatgctcgcacacgtgctttcagcaacatatcagatcagtaaggacacagcctagtgacgtaaactcaacatgtctagttctgaaagctaggaattaactcagagaccaatgctgaagaggggacagcactttaaacttaaactttccaaagaattaagtactgcaattgttaacacctcttccataacgccctaaatctagaattcaggtaaacctggaaatccctggttcaatctccctacaaaatgtttaagacattgataactcctagctaacgagtaccttccaggtccccactacagattctgattcagtaggcctggacagagcccaggaccgtgcatttctagcactcattacaagtgattccaatgcgggaatcctgtgaccatacttcatgagacacagtctgattcccaaaacttttttgggcttcaagatcacctgggaagctctctgacaacagattccaaaactcccttaggtgagtaggtgaggatgtagagccaaatttgggtaccaccgggctagaatatcaagttcacaaccatagattataatgtttctagagaagcacagatgttcttgttcatttggtgtattcgtcagtccttactgtcaaaaaccttccattctccttccagagaagacacactcgccagaagatgccctctggataactctgtaaaaatcacacatctctctataaattcatcagttggccatttgcttcatctttaaagagtgagctcttgcctccaacaagtggcaaagaggaaacatccaggtaaagcataagataatcagaattctggtccctactctaccgcttaatagctctgtggccttgaactagtcatttcacaaacctgggcctctcatcacctatgatgtttggggcaaagaagggagagggttggttaaggtcacctctagggcttttctgactgtaacactttattactcattccttgcatcataaaatccatttcgttcatctagaatgcagcatcagcaggtgtcaaggactcccaagtgcatttaaaaacgcaaagggatggactaaagtcagctaagctgtacaagcagcagaagcttctcatgatgaatgcctatagataggaaacaggctgaagcatacagctgggcagaagcccaaagagacggacctgacaaataacataataaatagaacttagtctagagagaagattattgtatttgctactgaagacatttcttaatgtacttccctaatcctcactcgatcaaaatagtgacattaatttgctaacactgacacagtctaaaagttatacactctcttcaaggacttaagaagcacacactttcctaactagatatttttgttccttagatatagtttcctgattcagcattaagaaagatttaagaaaagggaaaaggaaagatttcaaatcttcctgtagagtgactccagagttttcctgtaacccaattaacgcacatgctcctacaaaatcggaatacagaaatgggtcccaactgcttcccaggaggtagaataagctggataattagagaaggaccaaagaactctggtctgtccctaaaatacgtactgagaaactgcacaagacgggtaatgctacacaccacaggacagggtccaaagctccacaaattctttcaaaaccttgctagagatacattagtactacctcttacgaagtatgcctacttttcaaagtacaaccactcagaacccagatttagatactaccattttctagactattttactcaatagaagtattcagtaagaaactcagaaaaaaaaatatcctaaagcagtttatgcttaagttaaatgagtgagatccttctaaaagccattttaacccatattacaaatatgtcagtggtccaaatcaaaccaagattaccagaagttgagatgcctagtgttcagatttacctactccacttttgaatttattatcatatatgtttcttttaggaatcatgctcatatgttattgatgtgaacaggttaaactggtctgataaccagttaacaacaaatgatttcaaaagcttttatagcaccatgttcagtgtaatctactgtcagggagagatactcactcttcccacagtccccaaataggctctatgatcaaataaggccggggaactataattcaaacaggttttctttactgctggatttttcatagttcttaatacagtgattatcgagtatggatcttaaataaagaactacagagtgcagcacttcctaaacttgtctgtcaatataatacttatgttaagaaataattactagtatctcaccaaatgaaggttgaaaaacatctttcaatcttatacacactatcgtgggaaggcaaattaatacaccaaatacactatgaaaaatggtatgaaagttcctcaaaaaattaaaaacagaactaccgtatgatccagcatccccactactgcatgttaacccaaaagaaatgaaatcaatttgtcaaaagggatgcacgcatatccatatttattgcagcaatgtttacaacagccaaaatatggactcaacccaaatgtccatcaaccaataaatggataaagaaaatatgctatatatacaaaatgaaataccattcagccacaaaaaagaatgaaattctgtcatttccagaaacatgggtcaacttagaggacactatgttaagtgaggtgagacagccaaataccacacgatctcataggtagaatcgaaaaatgctgatctcattggaggcgagagcagaatagtgggtaccagagggtggagaagagaggaggaaggaaggagggggccagatggttaatgagtacagggtcactgttaaaagaaataagttctggtgtgctattccacagaagggtgactatggttagcaatattgtatagtatacttccaaatagctagaagagaggattttgaacactctcaaagaaattatgaatgtttgagatttggaaatgctataataccctgcttgatcattacacaatgtatatagcatcaaaacatctcactgtactccacaaatttgttcaattatgtgttaactatatacaaatatatactatatatagtagtgtacacgtaatatatatgtgtatacatcatatatagtattatatatatatatatatatatatatatatatatataatgtatagaaacgtcttacatctttagaaacatctttcaatactcatgaccattgtggaatttcttggggactctacttgcttaccaaatatttttaatagaaattttaccacagtggaaatctccattacatccttcccctcaagccactgaaaagacaacaggcaggggtcagaggtgaaggaaatggatgagaaatatttacacagttttttagtatctaggtatgtattaaagaatacccatgtgttgtgcttctattaccaccgtctaccacactaaagttagagaggcaaaggaggtgaagataaagaactcaaatttatcccattttgccacataacagctctaaagattcacaaaagagtaagattaattcaagattgactagaggtgagacgtgaggatctgtaagatgtctcctgtggcagatgcctaatatgaaagatgtatgatttgtctaatattttcatcttataaaatgataaaatgtatcatttcgtaacagtttcataacaaaacatgacttttgtgctctgttcatgcatctttctttttaatagtaaggggagctctactaagcaatcagaaattgcatcatttgtgtcatagccctcaagtcatttatcatatttttatcttttatattaaaaaggttgcaaaatccacatgtcaggggtgttgttttactttaaaaacaaaagataacatgtttaaaacatgttaaaaagatgtttaaaaacatcacgacagagacgtaagagcagccttttgttcttcacctttttcaacttattaaaaacactataaatttcacatatgcttatcacactcattttggaaaagaaattgaaaaatctcatccatctgattatcagtgttcagaaacataagaaccaccttcctaatatcatagtgaacatttaagcaacataattaaaatataatggccgtttgctatggatcaatgacaatcagtttgtacttagctttttaacttgatttcagtaagttgtctctgtgaatctcaatctgtagcttgaggaaatatgattatgagccaagtccaggggctggctctagaactcacttgcagatcttggagagaatgagccctaacgattaacggaatagctcaaagtcccatgtatgaaaaagtcaaaagtgaacttagaaatggcccagtgttaccccctttttctctgccttttaccttattttgccaatggaaaccagaagtctagggctgacttatccaatgtcacatgactaggtgagagttcagactcctggtctcattcttcacactgcctttaagtatcttttactcatttcaaatattccattttatatttttggttataagctttgtaaagcaatttggtatacactatcaatcaaatttaattaacatgaaaagtccacagagtctgtctaccttcgtatatttttagtgtttaacttcatatgtatgtctaacttcatgtatttttagtgtttgaaaacaactcctgcaggaagcattaacccttctatcccaagaacgtgctctttaaattaggttttggtttactctaaaaatttagtcaaatcttaaaaaatactaaggagattttcacctaatattcaaaatgtactataattaaggctttatctttataacaagaaggacaatcatataccatgtcctttccttgttaaggaacggaacataagatctcatcacgcttggtattatatcagtgaaaatgtttatacactgacaatgtgaacattaccatttattttatcatatataagcaaaatgattatattaacataaggaaaacacattttaagattttttcccctctcccaaacacatattgtatctcactgttgaaatgctaacttaaatacactcagggtactaaaagataaaagttaacatgacactggctatcccagatacatatacttttagaagattttccaaagatcctgtccagatcagagtacattaaagtccagttaaaatatatactgcccccaaaatagtttatgatttaaaaagaaaattttaaactaagtttcatattgctgatgtaataacagagagaaaatctagatatgtaaaattgcagcagtgaattatttacaagcagtaatcttattattttctcctatcttgagacacgatccgttaaatataaatcatctacataaaactgcttacctgttattttgtctcttacaagcttacaggactctatttcaccaatgctcccaaagagactctttagttcctcctgtgtcatgttctgaggaaggtagttgactattaagttggtcttgctgtcttctgtgttcccagagtcaactggtgacgaacagttgttgtttatggtggttggaccattggctgtgttattgcaagttggcccattagacagttgtgtttccatggcagcaattacctgctaaaaacagagaaaacaagaaatgtcagaattcatatttcacaacctattagagactccatccaagaatttaaacacttgtcactaaacacaagtcgttctaatgaaattacaacaatgcttcaacaaaaagtgtaatacctacactaattttcacttcatattaacctattcatcttaaggttacaactatattttcacatacatattccatacatgcatataagcacaatttaaatcttaaacattttctagaatcacattctgggtctattcacatatccttactcacctgcagtgtccacagatgagaaaatcaagtaccaaagggcacagaattgaaccctaactaaaaatcatactagaaaataaaagtgcttaacatgctacaaaaatgaacaaaaaaatgacctacctaactctgaagagattttcagttatcctaagaggttcaatattctaaaactgacagatagccattaacttaaaaatcaaagagcaagagtacttttaaaaatataaatttgtcaacatgtactgttttggttacatattgaaaacgtttttgatggacaatatcttatctctaccattggtaagaaaaaaacagatgctatattttagggagtggaaaggaactaactgtaaggtaacttgggaatgagctatgaatactttgtctaactggtagaatctaataggacactcctgtcaaccttggcagctaaaaattaccaacaaggtgactgatctacaacatcaaaataaaatccccaaacacttcgatatggtgtttctccttgactctgctttttaatgagaaaaaagaaaacctatccagtcaatgaaaacaacaatgtaaatatatcaacttttgcaaacagaccagcccaaggaattctcgtctgagcacataagcctgttgaaaatgcaagtaatagggtatctataaactccaaacaccagataaagaacagaattggggaaaatggcctcaaactgttcaggctactctacaaatcacttattaagcagtattaaatctagtttcctaaaaccaatcctatgcaaaagagtcacaaaccacagccccaaattttccaaaatcattttccactaactacctatctttggacagccaagactgtggtggaatctaaaaatcaacgcatcactgaaaggattatccttcatattgcatacatctctcacctccacaaagaactgcttctcaaaactgacaattctgaattgacgggatgctagttttagggaagctttaacatagaaaaggcaaagaacttgaggcaaagaaaaaaagcaaagtaaagggaaagagggttacaaggaaagagaaaaaactgtcttttaaaacacatattgcctaagaaaaataaaagggcacattagcagataaacatataggaagaaatctctactgccaggagatgtttacaaaagaaggcagtgttggacatattgagactggtcagactgaacaagaatcagtgctgtcatgataaaaaaacatgaggcaaaatccagaatagcttttgaaatatccaacaacctgtaacccctctgtgacttcatttccttgtcaaagaagtgggaatttattctacaagctgcaagctgtttctctacgtaagctaagttttctcagggaatacttaaagggatgaaggaaaataaacctttggaaatctgtatttaaaaatcttaaataattcaagatatgggttttattataattagcaaatctatttgaatttgaaaagggaagtttcagatttcctaattaaacataactgttctggtttgtagaatattagctgtgggtcactcttttcacagcaaaaattcttctggggttaacccttgcccagcagttatggaaacaatgagctacaagattaaagtggccaaagacacttaaatcactactgaaaagtttggatgggtgtagaaactacaagagacccgaatgggagattcggactaaagctcattgggatagcatttgaaatacaaagtgttcattgactgaaatcagcaagatttagaaaggacaacaaacactcctcacttaattgcacatttatttccatgttcaggtggcaagaatgagctcctaagccaacattcaagtgaacagctgcagtaggctgtgtgcgctgaaaattacagcatctctctgctataggaccatctgctcagaataaaatgatactaatgtgctatattttacaaataatgcatattccattgataggctcaacacaactgttcacagaatgcaaactctttcaacagttactgggcaaataattttcagccagatttacaatttcaactttttttttggagcataaagaattgtaaataacttcaaaatttagtaaccaaaaaaatacatagtaaacagaatgtatagaattacggtaacttagtattcagaccataccaaaactttttttgtttttttaaaaaagcttgtcactcttttgagtctgcgctaaatcctaatttagattgtaaaaaaattacatacgagagcatggttctgatgctacatacaccactacagttaaaattgcaatgtgctttaagtcctaatgatggccataccacaataggttaaatgtaagaataattagtatgccaaatgaaagattcaagtgtttggtatggcctcagcactcctccaacatgctaaaaaaaagtagcctacagaatttaagaaaaatcccacagaccccggtccaaggctctgctgcccacgaaccacttctaagcagagaagccacatcacacagtctgactgccatgttagtttggagttgccgtctgcaatatggacacaaaaagtaccgtatgttagatgagcaagataatgcaacaaatcagtttgtacaaaatttacagtgattgtattgatattcccagcacgtccatgcagtgtggcttaattgaaattgaggcaattccaatctaatctttccaaattcatttcaacatgtagttttcttgcacaaatataagcatttttaattaagagcctgattttaaaacagtattaactagttatcttggcatctattctgaagaactaatgtaaaccacacctcaaaaatttaaaaaataaagtaaaataaagcaaaatactgcaggctgtcttatctcttaaggatgtgggagaagggaggaaatgtgaatgaaattttatagtgggaaaaagtcatcatgcaattcctaagtgattggtttgcataaaagcactctttccccaaaatatcagaaagacattaagagaagctatatttgcccacactgttacattatactataaatgatccttaatcctgggacttaaaattaaaagtgaatcgaaaccctgtgaggttattttgccactacagtcaaacggtttctaacagtttcaatgagaattgctcacatatactaagaggcagtaaaccagcatctttcaattgaaataattggaccgataaataggattgtttggagtaatgctcgcataggatgtcagctttgtccctgaacgaaatcaagtgaacattttttaatatgtaaattgtaaacccagcacgatttgaaattagtgctgctatgaggcctccaatatagttaatgggccatttaccacttattgaaacttgcccaaataccaaacagagccatgatattggcacaaaagccaaagtttactttttttgccatatatgcagatgcttcaaatggtcaatataatcagaaaacttagtttctaaaaatagacagtgaataacagaagaggtccaaaaatgtcttttacttattgataattataaaaattttatcctgagaggcaatcctggctgtgatttactcttgatattagcaatgccgccagtaacgatggattccactttctggcatctatcaaaaaggattaacatacttttttacaggaagccatgaaaatattttactcttcttccgttctcccactgtaacaagagattttggtctgaccctatgttatttttcaaaaaactacttatagtttaactgaacctgtgaaaaagtgctttacacccatgaaagatttttcataagaacccaactgtagttaagactacatgagcaggaccacacccagcagggtaaagcaggcataaatgtatgtcctgaataccttcaggagttcaatctaaacattgctcactacataaaacagattttaatttaactgcctcagtcccttctatttcataggaggtggacactaatgagctaatctattgacacccctctttctgaaagccccagggaggtgaacaatcactttattgcaccaactagataggaaggctgtgtatggaaaatgattctactgcacttttacatttcaagcaccccagacagtcttctccgcttgaggcagacacatacctttatgggaagttataaataagttgctcacatggcccttacctttatgctggccaacaattcagttactaaaaatgtaaagctacttccccttcacttaaggacaggcaattctgctctactcaatctaccacagacaactgggctgtgtactatttatagattccactggctctgaaactcttcggaaagaaaaaaaaggccatattccagtgaaacagagccattaattttaaggcttaaaaaaataatgtttcaatatatattctcctcttaatttagacatcacttgtgccaattcagactgcttttcctcctgttattatccaagtaataatttacgaaaaggcactttagcatagatgaatctagaatattctaaactttcactgggctccaaggtaaaatggctgttactatggtgaaagcgtaggttttattgggaaatagaagattgtctctacttttatacacacaggtacttccaaaaagccataaagacttctaaactttttatttaaataatcctttatgaattttaacatctactgttttcacaatagtggaatttagaaaataaatgctttatatctcatatctgggaagagttaagaatttgagaagtcaaactgatccaatagtttcctggtcacatgagagaaaagcagtctatattttctaatcttacaattaaaaaattctgcaaactaaggtaatcagcttcttcactattttcaaacctcttgcagacagccactaaaccaggtagttaatcaaaagcatcttaaataggccagactcggcggctcacgtctgtaatcccagcactttgggaggctgaggtaggtggaccacttgaggtcagaagttcaagaccagcctgggcaacatggtgaaaccccacctctactaaaaatacaaaatattagctgggcgtggtctgtagtcccagctactcaggacgctgaggcaggagaatggcttgaacccaggagggggaggttgcagtcagcagagatcacaccacttcactccatcctgggtgacagtgagagactctgtctccaaaataagtaaataaatatatcctaactatattctgagagttgttattaagttcactcagtataatgttgcgaggagggaaaaaggttccatagcctagaaaccacctgatttagggaccagacttctgcgggttaaagtcatagcagggctgctgaaagggccaatacaatgacccctggtgaggctgcgcctgttgctccagccactccattgccatggtcaacatcctgacctgggctctcatcttcttcaggaccagcaaattaaagcctccaaaaggtccctctctcctcatcctaatctaccttaacaatgttcccaggtagactttctaaaccctcccacagctccctgctgcctatcaaatgaagtgtaaactactaggtatcaacagaaatcctgtacaactacttttatcagcccacttattcaagcaccttaagatctgaactactccttgtccctcaaacagtccagtaccttcactcttctagctttgtttatgcagtcccatctcccttattcaaggctccatccaaacccaccccatctccatttcaggggtttgtacaaactaagcattgaaaaagcaaagggcaagaacagtttcttaaaaattggagactgaaagagcaaatccctccctaaatgtgtacaaactaggtaacttttttttttttttttactttttacaaatacatttaaactataaattggaaacacaaataatcatgagtggctctaacttgtttttctatcccaccaagtatttcaaaccagaagtaattatgaaagcatattttcaagttttgacgcactccatcagccaccctcacccactgaaatctaaattcctattatatggtaaaaggaaaccatctacctttgtgaaaagttgtgtatttttatttcaacaatctatcacactaactacaaaaccctggaagacaagacaaatccaagcctctggccagcagggttatggatatgggcatgtggaatttgggtccaacttcaggaaaatggcaaaatcaaaggtaaatgcaggaaaattaaacagatcttgaagaaggcatttagaagcacatcatgattaagtcgtggatcaccagtgatcttcatactaactagaaaagtttaggcaaacagaaacgataacatctcttaaaagaatcatggctagaggcaaagacaagcttatctctcaggctggaaaggtccagcctaaacagagtgaacttggtctctacacttatttgcaactagaagctttgaataccctgagtattcaaacacagcacaccaggacagaatcagcccagtacaaaggccttccttctgaccacatcaaacctctccctaaatgccaagttacagatgaacagaagacatttgtctctaaagttttagagccaaacatacaaaacacaaacaaacaaacaaaaaacaaaaccaggcatcacaacctttaccacaccatcctttggggaacttgcagcagggacaaaagcactccaaaattggtgaaataagtcatatgagcttatagatgacagctgggtaggcagtcaaagggatcatctgcccgacacacaccattcctatagcaaatgctttatctttcccattcaaatcactaagtggtattttcaggatatgtttgtggtttcacttaattaagcaagagaatagtcaaccaagtgctaaaatcacaaggctaacaatgtcagttacaggaacaagccattagtttgttttctttaactctctttgctttgtgattcctaaaataaaggtttgtagctttaaatgtcaaaggatttattcaatctagaatccttgtcaattctccagcccacccacataccatgttagctgtctcactagctctacgaattcctcaaacccacattttcagccttggggctaacaacggcccaagaacttgcagagacaatgcactgaacagctgcacgcgtcataaggagaatgttctttggcagcaaacactaacgtttttctgtctcttggccctttatgacttctacggacaaagtacacagtctccttcatgccagtctttctgaggttttgtagtttcagagctggcaggttcaaaagctttgaggttagagaggtaagataatgagtttagggtcccaagtccttctcttcagtctaagtccattacaggtatccagtttgagcaatgggaaagtaaagatctggcgaaaaagatctgcttaagtttcatgttttgttcattcatccattcaacgaacatctccatgcagctcccacgaattcaggagagtcctgaggtacagcaatgaagaagcatcttggagtgctgatttgctgtggatggtgtgtgcagaacatatacaagtatgaacacatagaagaaaacagtacatcagcaataagtaagagtgctgtggaatacatatagagaagaataaggggggttgaaaatgtggagatgaagacgggtagtttccagcattaaacaagcaggcctcaatgaaaaggtgagctttgaaccaaggtttgaaggagatatgggctggctgctgtgataggaagaaaaatccccttcccctcaatgtctacatcctactcccagaagtgtgaatatgttatgttacatgacaagggggaattaagattgtagaattaaagctgctaatcagctcaccttgagaaagggagattatccttggttactgaggtgggcctaaggtaattacaaggttccttataagtgaaagaggaaggtgagactgtcagggtgatgaagcatgagaagaaatcgaaaggacattgctggctttaaatggggccaccagccaaggaatataagcagcctctaggagctgcaaaaggcaaggaaacaatctctcataaagactctgggaggaatgcagccctgccaacactttaatcttagcccactgagaaccactttggacttctgatgttcttcggaattttaagacaataaatcttgtattgttttaagccagtaaatttaaagtaatttgttagaggtctaacaggaagtaaagacagcccccatggagatatctagaagaaaagattctaggcagagacctgccagtgcaaagcttgtctgctgtgcagaatgacaaggagataacagggagagtaggaggagatgagtctaagaggtaatgaggccggaacacatagggccttgaaggccaccataacaaaaaaggaaactataaaaggttttcagcaaaagagtagcatgtggctactgtgaaaataaattgtgtgtgggtgtgcaggaagactcagtgagtttggaaacagaccagtcaagaagcaactgcagcaattcaggtgcaggatgacagtgactcccaccagggtgaagttggggagaagtcatcagattctggatatacccagaagaaaacacattattaaggtgctacattttaattacatcagtacactgttgaaatccattgtcaaaaaactggtttagatactaactgctcacattcctacaaaccaccaaaacatttactatgctctggacactaagaacacaagatgaataagcaaaggaagagattttatggacagttgtgccttaaaagaaaataaggatatatatataaatctatatatagatatatataggaaacccaacatacaaaaattttgactttataaatattaaatccagagttattcactttatggttggatattcactattcactttatatttgctactaaatgaatccactgccagcttcttaaagaatcaactgattcatttaggagcaaatataaaatcacaaatcagtagcttaaaacatgcaactactactaaacatagtatatcagaaaattgatttgtaatctatgtgagcccccttaaaactttcagaattcaaagtaaaatagctcaaagctctccccaaaagtttaaaaacaaagtggatgaagattagattaagtcacattttgtaaaatgggagtaaactttaaaatctgtatttttcaacagggtcatttatatacctctacaatagtaaaggttaagccatgagataactctgtcttggttataggctggaatacactaaatcattaccttctggtgatgaatcattccaaccccattctttcattccaacctaagtggacccaattaatttccatgccattatttggcaatagaatctaaaaagggatatgagtacaacaagaataaaatcaactactccctcagttttgtggcagaggttttgtttggtataggcagattaatctgaattgctaaattaagacagttaacatagtaatcaacacagaaattggattaacttcacattcttctacaaaagtcacagctatcaggaaccccctcagggtagtacaaattgtgaaaggctgattggaaatcctcaaattaatcccagtagttgagtgttttcattaggtaggttaaaaacatagctcctctgttggatacagacactaaaatactctgtcatgtacaaactccaaagcagaaagaatgactaatcttaaagggaaaataaaagacaaggaaggtttatggacaaaaataatgttttttaactcacaaatgttataaaggccacaacactcctcctggccagtgaggttaacattttatttttcactgttatttagcaggacttagagatagaaaaccaaatgctacactgtttaacctcaagcagcttacaccaaaaaaaaaaaaaaaaaaaaaaaggcatctaaaatgtcaaccaacaagatttatttccttagtaacattaggaggctacaaataaagggatgccatcccagggcacataaatatcttagaattcattgatgtattgtggagagcaaaacaaggagtctaaaaaccttgatcaatacagacagcttccttctgctctgaactgtggatcatctcaattactggtattcacctatgaaatgtgtttttcttttctgttgatgtgtaacgtcctgagattcccaagacatgtatacttgtgatttagagacacaactatgttttatttactatggaaatttgaggcatcttaaaaaaacaagattcacaccctaagatagtaactttatttcctttggtccacctctgcctcttgctcccccaaagacagctttctttaaaaaccgacatcccagctagaacaaaacacacctaggtacatctgtgactttttatggtaattaagttcctggttatttactacatttcaagaaaaaaaagtgggggagggggagaatttacattcaatgcaagtgttatttttattcagtgattccaaagtgaggaaagggttgctaagggcgagaagtatctcaaggaaatgtcttgttaatctgctacataagaatgtatataagagttaataatgtttttcaaaaaagttaatgctagacactatagaacaggtaaggcccttcttagcctcagaccttatccacttatatccacatcaggcacatacacccaatttcgaacaaccccctaacagagaaaggggtcaatatgcttagattgatgacctcaccatctcacccagcatagagcttcctcttactcctacttttgtcagacttcccgctttgcaagttgtcttagtatcattcaagtaaagcacatttgaaacgaacgcttaaggatctcaaaaagtaggtggggcaagtacccccatgttacagatgaaaaatgaagcaagtgtatgagcatatatgtatatgtataacctgtatatacattatacacacatattcccaagtgttgatgagaaacatctatcccccacaggctgaagaggagaagggagcacatacgcaattacaggctacattttaacaggaaattattcttaagactcaaatcacaaaagcattagcctttgaattatttccactctaggaaggaaaagagcaggtaaaggggtctgttctctttaaaagctttaattacatatacatattttgtctgataatgtcaaagcactttacaaactctaaggtgccaagtgaacagagggtattatcattattgctggacaaaacaagatgtctcttaaaatgttagcatagaaaatttgcttatctgggcctggcgcagtggctcacacttctaatccctgcactttgggaggccgaggcgggcagatcacgaggtcaggatatcgagaccaccctggctaacacggtgaaaccccatctctattaaaaatacaaaaaattagccggacttggtggcgggcgcctgtagtcccagctacacgggaggctgaggcaggacaatggcatgaacccaggaggcagagcttgcagtgagtctagatcgcaccactgcaccccaagcctgggcaaaagtgcgagagactccatctcaaaaaaaaaaaaaaaaaaaaaaaaagaaagaaagaaagaaagaaaatttgcttatctgtcttttggattaagcctgtcagtttttcttccccccacatctaaatggacagcaaggctgcagagtcgtgttgggagccttttaacatggaaaggaaagactgtggacagaaagtacagtatgcagacttttcctaatcatgactgttaattcctgtcctggactgctgaagcagatgctatgttaaactacatttagcacagtcacaaacggtgactaaggaagttaaaaatttttacttgcaatgctgcaatttttaaccccagacctccaaagactatgtttaaatatacagagtactaacagcccaagtacttcacattagaattacagccttgcctattttaatttaccttatttttaaaagtgtgtgacccccacccccctccccaactccccataaaaatacacatctcccatcctctttgagcctgcttatgctcaggctcttggaattttaataagattagaaattgctacctccttattctggctaagaactccaaagatgatccaggcatcttgtacttatattcagatttacaatacagagaaaacaagagtgtagaaatctaatccacgattataccctagaatctagattaataatgtgtacattatgagatcacatgggatcaagtttccacaattaatggatcaggcaaatgatccatgtatctacattcatacaaaatcatacactctcctatcatctttctcctatcatgatcttcaaaaatgacctgaatttaaactgtggctttaaaatcacatttaattacaagaaaaatagaaaaggaactttccgtgggatttgagtatcttttgctacagtaaagaagttcagatgatctccctgccttctggagaatccaacgaatcctacaactaaaagtaaaaataaatggcaagggaaagaaactagcaattattgattcctctttccatgccagtctcaagctagatatttacaaacaaaatcttatttaatcctcttgtggagcgggcaaggtgactcacgcttgtaattccaacactttggaaggctggaggacaccactgcactccagcttgggtggcagagcaagaccatgtctccaaaacaaatcttatgcactataagctatattacattctcttcaatttacaaatgagaatttcaaaacttcaagagttcacacaagtattaagtgagaaactgggatttgaaatcagtgctgagaccccatctagagcttcctagctgatctctctatttccaggcttgcccctttctccaatccttcctccattccacggctgtggggatctaactaaaataatgggcagcactccactactatctcttttaaagctctgctcactccacgttgcctatgaagtaacatctcagctccctagtgaggcagctgacttgaccgagctcctacctcttcatccacatgcccagcacccccgcatcatatacacaagctctaacaagctcccagtagttcttcccactcccagtgttttccagtgtcacccaacctgttttctccacctgcaacagcctacctttcttctcctgcctcatggaaacatcctcagcaccggaagagagcagacaaacctcgaggaagccttctgtgaaccactcagttggaccagataactctgtgtgctcctatatgcctgactcacctttatctccccagtaaaaaatatcaagacagatccataaagagaatgaatgccatgaattgtgattcaaggtggcaagtaaaaaacaacccccttacttatccatgtggttttatgttccctgccaagtgggaaaaatttccattgcaaccctgtatagctggaggagcagccaaagtcatctcaggttgtttataaagaggaaggtagactgtcaaggggaaaaaggggaaagtaggctgtcaagtcctaccactaacacacacatctctttccgcatatagctactaattccatattgtaagctcaaacttcaagtggaatcagcattttttaattcctagctacaagcctttgttaaaacaatataaacctcagggaggaaccagggacaggtgtgttccattgtcaccatctcacagttcaaaataagccaatctcatcaccaatgtgtaaaatcaagaggaaacctgaagtttatactctctccccaacacagccaaggtctggtgtgtagaataccaaaaagaggagtaaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctacctgacctatgctaaatagtttgctatcaaaaaaaaaaaaaaaaaaaaaaagatggcaaaatcactgctgctatggaaactaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtacccatttcctgttacaacttcatcctatgtaaagtacaagtttctttaaaagaactctcagtagagtagatttaacatgtaaattgcttagcagtaaatagtctttaactgttgataaaactttcaggaagtacctactaagtaccaggcaatatagtctacagcagttaggactgcaatctctttcagatcgagctaaaaagaaattctcgctatcatccactactttaatctgagatgggtatgaacaaaaagatccttaaaccactcttctaaagggaaccatgaccctgaacccaaatttttcaattcttctgtgaagagtgtagatctactcaaatgccactctatcgctctatcttagactattttaaagagttccttgacgattctgagtgccagtctctagttgagaatcactataagggaaatagatggtttagaaacgtgccctttctatacccttctgccccacccaagcatgctttttacatccatcctttgtcaggctaaaacccaggattcacaacaaagatctggagactgcaggccttggaattgagttgagtcatcaggacactattctttattctccatttctaaagagcaaaagtgggaaacggggggtatcatgaggtagaagcaagaacggtaaattaaaactgaagaaaacttccactgcactggaacagtaattagaccaaatttgcctgccatcaattaaggaagaacaactgctctgcatcgctggctaccaagacagcagttagttctcttaagtaacttcttgctctaactggaaaatgacccatacttttacttgccaagaataaagacagctggcctcctacattacaaataaccaaaatggaaacaagtgaatcttttttatccaccaaggttgactacacattaactaagacctattctaataaacatggccaacataaacagcagcagccaggtggcctactctgaacattcttcctgatacaaagtacatcatatacctaagggcatggtgaacaaaaccccccagagtggctatgaccagcaggaagaaaacattgaggggatgggagtcaaaagtctacttaaagtattaagcattcaaataaatggcagaatccgagggccagcttgcaaaaacaaaaaataaaaagccaacaatggactctgcttaaataaatcacgtgcgaggttgaaaagaaggacaaaggaaaagtggcaagggatagacaaaaacaagcagattctgtaactctcctcaacctccaggccaaagttcggactggcagctagcgggtagatttagcctgaaaacatgttacgtggtttctccaacgtccttaaaaacaaaacaaaacacaaacaaaaacagtagtgttcaacatttaaaatttcaccaatgtaacaatttcacattcataaaactatatttctgatttcgcttaataaataaagtttggcaagagtccatattcccagagctactagccagcaggttgccctataaatggggtgccttctttccagctctcccaatacagccttaatgttccggcccctgcaagggctggattttaagtaaaagagtatcatagcctaaatgtcaaatgtgctaaagagtatatgcttttctaccatgatggagaggttcagaatgtcagagtactgggggagggagggggttttccaaggtcatctaaactgaggatctttaattgtagacctaatcatctgtgaaaatattctaatgaatatgcataacaaaaaatgaggcaaaaaagcatcaagtctgtgtcactaaacatcctaatatgactgccacagacattcaaagcactctaaataactcattttggcctgtttatactactatggatttggattagaaagtcatcctgtccacaaagaattaggtatatcctgtcccttctgggggctgagtttgagacagttaattcaaacctaatcaaatattttgctatgagaaagaagaggaggggccaatgaagtgctttatccccaggatgaggcagtgagtagggcagcacacaaaaaagataaaaatcacctggcactacaccagaagcccttgaattaacattaaatttccaggttaacgctctaaaaactgtctcatgacaaaccacaaattgtattttggaggtaaaacaggaggtaagtggggaaggaactgaagggtaaataagaggtcttacttcacactttttctgctgcttttggtttaccccagtagaatcccatgaaaacctgcttcacactggcaaagtgggcagacagaggaacaaaggcaattccagggcctgcagaaagtcttcaaaggcaagggaagaaagcaacgccctgcctaaacactggctatttatagcacagcaatggaagatctgggaggtggctgagggaatatgaaagctagagagtgggtgggcgggcttccttctggcttccttagactcagaaactaatgcattcttccctgcctccaaagctgctattttgtttcctgtgtaaggtttcaaaatactgcaacactgtccctaggtgcatttgacaatatcagagcaattacagtttggttaaaatctgaaggtaatcaactcaccattctttgctattctctagaaaaagaggcctgaacaaagaggaggagacaccaccatccaattcataaggatggtctcccaaaatcccctgaactttcacagcgcggaaagtttctgtgatttcaagcagagaccaggagaaactatacttttcacctcttctcattaactaaaagccacagctaaaaataaaaagctggagcaattccaaaactgtgggttttatagggcacattaaattattccttatcaactgcaaacctttaaggttgcagagtattatgttaatgctattggctttttcttttttttccccagaatcggtgatagtgttccttaaaaaaaaaaaaaaaaaaaaaaaaaaaaaaaaaaaaaaaaaaaaaaaaaaaaaaacttcatgaacttccaagtccaatctctattgcaaagtaaagtatgggttcctaaatctgcagagaatatcatctattctacaaaacctcacacataacttaggttgattctcttttccaggactgtattataaaacattttgaactgagaacagatcaacagttggtattaatagtaaattataataatcattttacacttgtttcctaatctcatgcatgagattcaaaaataagaaagcagtctaacaacagagaattttctaaacagaatgtgaagctctcacatttattcaaatataaacactaaaaagtgtttagggttccccctggacattcaattgttattaactcttaagataaatttccaacttaataaacttggaaaatggctttttaagcatattttcaatttgttgaaagtttataatattgaatcctatgagtctttttataattattttcttagaaaatttgtggtcaatttcctgtgaccttcgtaaaacttaaacacacctcttagctcacatccataactatgttggcttataccaacattcttcttatattcttcattaatggtcaaggttaaagaaataagagtatttggtctaaactcaaatcaaatgatcatgtgtaacacacagcagcacccaaaacataagcactattttccataactaaaacatcagaacctaaggcatccatttataccaaaatgaagattttagttcagctcttcaggagagttaagacatggccaggtaaattaaggccaaaaaagggcaagtcacaacactatgtagcattcaggaaatttggagcaaatttaagctttcacataaaacagtcagggttaggagtggcctcagagaagcaattatctcattcccaagtcccaggctaacaaactaacagggatatggaaaaaaagactagaacgaaggtaaaagcctacataaagtccaaagacaatcactgctggtcctaaatctatttcttaatgattctgtgaccctcaacaagtttgttatgttcataacttccctcatctattaagaacagatttttctcactctgctagcgaacagggttattaaaagaaataagttataacaaattacagataaaagaatggcttataaaaaatttcaggcactatacaaagtagggtattgttctcaaggcactaaccttcttgagaattgttttctgctttcatgctctcctaaaaacacatctttaatttatggtaaggtcaaactgccattatcactgcaacctgagaaattcaaattaatggtcaaagatacacataaacacacacactccaggctttgctttcttctttccctcaaaaggtcatgttttcaccaaacagatcaggaattctacaatatactacgttccaagtaccaaatatttaagccaccaaaacatacagcagaatagcatatttaagaaaagtttcttttttttctttccttttttttttttttttgaagataggttctaattctgtcaccaaccaggctggagtacagtggtgtgatcacagctcactgcagcctcctgggctcaagggatcctcctacctcagcctcttgagtagctgggaccacaggtacacaccaccacaccccgctaattttttaaatctttttttgtttgttttttgagatggagtcttgctctgcaacccaggctggagtgcagtggcgggattctctgctcaccgcaaactctgcctcccgggttcacaccattctcctgcctcagcctcctgagtagccggcaaccgccaccacgcccggctaattttttgtatttttagtagagacggggtttcagcgtgttagtcaggatggtctcgatctcctgacctcgtgagccgcccgcctcggcctcccaaagtgctgggattacaggcgtgagccaccgcgcctggctaattttttaaaatcttttgtggagacgaggttttgccatgttgctcaggctggtctcaaactcctaggttcaaaggatcctcccacctcagcctctcaaagtgctagaattacaggcgtgagccaccatgcccgaccaagaagtttctttaacataaaaatgtccaagcagataaccaagtcaaaacacttttattactgaacagcagacggtgatgttttagttggcaatttaagaatcacacgctatagctattcctgaaaaattcaaaatcaaagtacatcgtaagcatttgctcagaggctagcatagtgcttaacgcagagtcttagcattctcaaaaacatgcaagaccagcctggccaacatggtgaaaccccagctctactaaaaatacaaaaattaaaaatacaaaaaattaaaaatacaaaaaaaaaaattacaggcgtgtggtagtgcacacctgtaatcccagctactcaggaggctgaggcaggagaatcacttgaatctgggaggcagaggttgcaatgagccaagatcctgccaccacactccagactgggtgacagagcaagactgtctccaaaaaacaaacaaacaaacgaaaagaaaccaaaccaaaacaaaaaaccatgcaagagcttaagccattttaaagagctgcaaccatgaactaagatttagcctgaagacaattagcgtacgttccatcccataccaagaaaaccactttatatgctcaaatacttcttggtatattctgccaatgaggcgattctacctgaatttattaataaactatttaccagcctgcttgaccaccaaggtttggtaaacagacttgggcccgatgtggaagcatagctaaggatggagaccccggggcacaagaagtgagctgaagtgaaaccaggaaggaagacaaatttctttgatagcctcttctctttccaatcccagcttcccatctcagttgctcattgtgccttcatcccctctcccatttgagagctcagctgagtctgcagatatcccaagatactaactggtaactatttggctagagtgagagcccacttcattttctatgcatccaacaaactcttatctcaaaagggcaataagcatacctggaatttactccaatacctgtgaaaggtagccaaactctactctccggaggcgtgaagtcatcatacttccagataagacattaataagcagaattatccttacctcatttgttacactttagtcctccaaattaaaaacagccaaagagaaactagcttgtaaacaaaagtaaatattcaaggtgccaagactggaagacagcaagatctcactcagctcacagtctgaagccacttaaatggagtaactccaaggaaaaccgaaagttaaactgaagaaaaacatgtaacttcagagagcatgaaaaactggtacaattctgcacaactacaaagtggccatgcactaacctgaaaacaacgaggttcattattgaataaaggcatcaggaattcttggagatggagctttcaaataaggctttagtcaccactaaaaggacacagaagaaaacagatatgcctcaaatatcaacacatttgaaggacagacatctgcattcattctaacatgcaaatcctatgtgcagggcactgtgctggataaccaagatgactcagataaggagttcccacttactgtctaagcaaagaagggaacacatgcagaaccacaacacaggacgcaatctggtaagtgtgagaaggagagattgtatctggatgacagatgaaaaaaaaaaatcaggctcagaacagagaaaagccatgtgcactaggctctctgttgtcataggttcaaataaagggcaaagtacacatagttgcaatcatttttaaaatgctgggcacaggccgggcgcggtggctcacacctgtaatcccagcactttgggaggctgaggcgcgtggatcacgaggtcaggagatcgagaccatcctggctaacacggtgaaaccccgtctctactaaaaaaaatacaaaaaaattagccgggcatggtggcgggcgcctgtaatcccagctactgaggaggctgagacaggagaatggcgtgaacctgggaggcagagcttgctgtgagccgagattgcgccacgacactccagcctggggccacagagcaagactccgtctcaaaaaacaaaaacaaaaatgctgggcacagagactatagcataaacaagacaggtactaagggaacttagtgggagagacatattaaacaagccaaagaataaagctaatgtttagaattgcagttcatgccatgaaggaaaaaaggatgctgtgggaataaaactgggacagtgatcagaagaaaagccttctgcagattaagtgacatttaagctgagatctaaagataaacatgactacatatatgtaatacttggtctttggaaggtaaaggatggtgccacacacatactaggtagtgttgggggcagtgggactggtgaataagacataatttgtaccctgaggaatgtcatcctagggatgcaattacatccaatatgtggaacccagcaggcagagttttacaattatggataaaacttaagctacagagatcttgaaacccatctatcctcaaccattcctttttatcaaatgaaggaaatgaaacccagaggctggctcagtgtttctgaactaggtaggtgcagaggtggggcacaacctgtaactcccattacatcacactgccaattaactttttaatcagaatttatgtggaatgtcagaattcagtaaattgatcatgtacaagaaacacttaatatccgtagggaaaaataagtagacttgggcctaaatgccaagtacttcactagacattgtgggaaaaatcttatttggttccaggcaaaataagaaatgtaatgagttttttgtaaagtgaaatatattcaatttctcttgtgaagttacgtgcatcctactttggggcatctaagcaaaccaggaaatgacagtgataatagataatgtgtcagatggtcttaaatgcctttccttggcaaaacagagttgacaaacctattattcccctcccacaatgtacagttttacttcttattgtacttccctgagaagtacatatatcaaggaacaactgtcacaatgagggttgaggcagtagagggagccactcccagagttcacagcagcactgttcatcaaagcacaagaaatgaaaacaaagtgtttatcaaggaagatgaacaagaaagatatgaagataaagtcatacaagttcacacaattcaatgttcttcagcagccaagtaagagcccacacatagaccaaagcatattataaaatgagaattttgatgaatttaacttagtgtcctggaggacaaaaaaggacttaggatcttttagttatcacagctgcacctacaagtcaaatataggcaaaatgaaacatttttaatcagatatctcccaaattttgcattactttaaggatagtgtgaaaacaaaaataacaagggaggaaacaatccccttcaaattgaagccactatagctcaatcctcactgtctcacgtctgttaacccaaaactcccagtatgagtacgaatcagtcacgacatagaaatctagacctattctgtcaatgagcagctgctccaggtctgcatcaatctgtaaacaggtatttccaaagcatatgaccagctccagtctgagcagaataacagatcaaaactggagaggacacacaatgggaaaagtagttgatcggtttgatagaggaagagacactgggtcccactcaaaaataaagtatctcaactttttcactgaatttacattcccaaagaatagattgtaaaataagtaagaatcccagacttttcggtacttgaaggtcactatgaggtcacctggcatagtgatctactgcaagaacagcctgactggtcttcactgatgctacattctattttgtactctgtctcaagctagctgaacttgagagacttctaagtctatccaaggacatttgaaacatttgtgataaatgcagagtatttatctctgttaacaatgaagaaaagtcaccttccagaagaattgctgtgaaagcccacatcgtgtgcactattttttaaaaagtaacatagaaaagctgtttaacataccaggaaagtcaaggagaactttaaaaaaattataaccataatacctaatttcatcaaaatgatgtaagcaacaaagatctaatttatattgagataaactatataggctcagactattcaggcaaggaaccagtaaatgcttatttcatactgaaatttacaggacatgaatgacttagcaatatatattgaccctgagctactgaaatgacaacaacccaaaggtgattactgacatatcagaagaataacaatgaaacttgagggcgagagtctctttcacactttaaaaaaaaaatgcagctcaataaaaatgtacctattaaaaatagaaagacagttatccctttcaactggtgttgatctgccctttattactggagatagactgtatcactcagaaagttaccctgaagctataagaagcttggaggaaaatattaaacttcaaggtacagataggaccaggagcctgttaagacagaaaacgaagacattaatgttcaaaaagtatataagcaggaaacctgcagtagtctcagtaacagattttagtggcaaaaaaaaaaaaaaaaaaaaaagagagagagagaaaggaaagccttttaaaaatctaagccactggaattttaaagtgacacccacatgacccagtttacttttctattcaaagaagttctgatgctgtttctctatttctctttggaagtttttcatgtccaatatattgcaaaagataaaaggtacacttttatttaagcacacaatggaataaaacatcactgaggaacttggacctgtaaataaattttaatgggaaagacaagaattcaaacatgaggaaagggcaacagatatatatacggcaaatgtgagaaagaatatgagcatttggaaaaggaagacaacattgttggacagggtaggatgacagctattaatttaatttaggatatgctaggccatgctctaagccgttttaaagggcattacccccctgtgatcctaataacttaataaaatgggtcatttcatccccattttttttttttttgagacggagtttcgctcttgtctcccaggctggagtgcaatggcatgatcttagctcactgcaaactgcctcagcctccagagtagctaggattacaggcacccgccaccatgcccagctaatttttctatttttaatagagatgggtttccaccatgttggccaggctggtctcgaactcctaacctcaggtgatccaaccgcctcagcctcctaaagtgctgggattacaggcatgagccaccacgcctggcctcatccctatttttcaaatgaggaaataggcttaaaaaaacaaaaaaaaaagattaacttttccagaactcacaaaacctgccaatgtgggtctaacaaactccagagcccatgctctttgcaccacacatcaatgaagcagctaaaataaccaatatcttgcttcaccccagaccaattaaataagaatctctcctaagggcccagatactggcatttttatcagcacccgatttgattctaatctgcaagcaaggatgagaaccactgtaaaagacttttgtaagacaagtggactatcagctaggtagtgccaaacaaacaagagtcaaataatcagagactggggaattcatccagcttttagagggcaaacagaagttcaaaaacagtggaggtgctgaggcagagctgatccagactaacttcagggaaagtctgaacacaggctttagtccaagcagtgattaaaaaggcgcaaaaaaccaggttggaatcattttgctgagagaatgaactacaggttagaaaatttttacttttaagactgtaggtaagaagggagcacaaaatgacttttacagctaatgtaaccaatgggtatgaattttaggaaaataaggaaaaaataacagttgactaacctaaagccaatggaccaggatataaaatataacaagtgagtgacaataaacagagcttgctgagcaatcggatatagcctagtagttacaactgttaactctacggtgatcccttctagcatttgccatcctaagtcttgatttcctcatttaggaaatggagaaaataatcctatcatctcattcagttattggaataaatatatgagatatggcagtcccctttttaccaggcactcaaaagccccaatagatgcctgaaacttcagatagaactgacccctaccatgttttttcctacacatacctatgataaaatttaatttctaaactgggcccagtaagacattaacaataactaagaactgctgtaacagtacactgtaataaaagttatgtatatgtgatctctcagcgtatttagttttctttaagtcgagaactttcacctttttacttaaagggaacatggagcactttaacatcctctctttggcatgtcagaactgccagcatcactactcttgtgctttggggccgctgaaagtaaaagaagggctacttgaacacgagcagtgcaatacctcgaaagtcaatcttataactgagatggctatactaagggactaacagcatggatacactagacaaagggaggattcacatcctgactggtcagcatgagggtacatcacactattcagaagtacacgcagtgtaaaacttgtgaattgtttatgcctggaattttccatttaatatttgtgaaccacagttgactgcaggtaacggaaatcatggaaagcgaaactgtgggtaaggaggaactactgccatccaagcaaaagaaaagagaccaacggcttctgtattcttatagagggcagtgtaagaatatagtcccccaattttttccttcttaccattacaactttagatggccttgttaaagactcagtaaatggggaatagaagtttggcctgcttattcagttcctattagtccctatatagagggactgcttattcagtccctatacagagggtcagtgaccctctatatcagtctaggccagtgcccagacactagacgcagccacaagaaatgcaagttttcctaaatggtaaggtggaatgtatgtcccctaaccctactgaagtgaccgtcatttcacaaatagtgaatttatatattaagtgatttattaaatttatgctacatacaaaattacgtattaaaatgcatatgtgtcctcaactgaattcttgaggcatagtattgaggaaacagttcaaaatagtaatacaattcggtaaaacttttaattatttctcaaaagaatccacacaacttaaaatctgacacctgctgaatgataaagcttggtcatctgcacaacttcctattcaactttcattttcacaaaccttattttgtcttaagatgatttccacgcactcagcagggtaatcttttagctaaatgatccgaaacccacaatctgaatggcaagaaattgcttcctaaataatgtatcgtattatacaagctatcacatatctcccttccccagaaaagtaaataaacattcttaaagacagcccagaggaaaacagtatggttgcaaaacagttagcttcttatatctttcaagactttactaaatgtcacttataaatgagaaaacatatttgaagtttttaagtgttctatgctttttaaaccctttcctgaatgtatacaggtaggacactcagaggtaaggtaaggggtaaccatgttcctaaattacattaatttctaatgcctgaaaccaaagttttcaaagggctataaatgcttgaataatccattaagatacacaaaatgacaggttgatggtaaaaaaggggaaaaaaaaaaaacaacctttcaacaaatgacaaattttctcctaaatcattctttggttagaggaccaatgtaaaagaggcaggtccgagtgctgttttgtactggaaacaaaacagatgtaacaggtgtaatgaataccagagagagatgagacagaaaatcttgaaattaaacttctgtggtagaaaaaaagagagggaatacaaaaatatatggaaatgcctggttggatgaaaggagagtagatattctaaccaaaccatttaaatccacattattagacaccccaatacccgctttcccagtctgtgactgcacaggtaaagccaaaatatattttctgctttggaatagattttctacttaggattagttacaggcatatcggctgctctgggaattcactttcaaatataatgaggccacactaaaaacttgaaggaagtgaaatagtatccttcatctcatctgtcaccataaagctcaacgtaaagaaagctaaaaggctcactgcagtccctcaagaaaaagttaaaggtttgactctctgctgattaccttgaatagacagccaaattaggctggagcaaataactataaactgactatctaatgtaactaggcattagccattcatcccagagctttaattttatgttttatatattacggttcccctggtgattttccgcatacctcattaagttctgacttgaggatgtctgctctggacgagcacacagagcaacacaacacaaaacatcctaaacctcacatctcttagtatttccaacacaaacatcgcaggtctcctgatgaacacttaacctctacatgttctctaagtacagagtgcctagagtctcagagctgcacagacaccagcagacattctgtgaaaacactgccaagaccctcttgacatctgtggcaaaaacatcctgtcttctaaatatatgttctgtttaagtggcttttaaagcataagcatggtgcctttaaaagcagtttgtaacaagaggtcaaactataaaactgaagaggttagagaagaaatcaattgtatatcaattgtcaaaactcaactttaaaaggcagaggtggtcacaaactactgtacagacagggtaaatggaaaagaaatctccaggttgaaaacggcaaatgctaatcgcaggggtgggagcaaggagtcttgaccaatcgtaaagatgagaaagcatttcccttctggaatgaaaaactaaaactgtagatcagaaattcaggggaaaagaatcatttctgttcatgcctcgagaaattaaatacccttacccctgttagagaactgaagtgtatctcccaaaattaacatgttgaaaccataatctccaacgtgactatatttgaaaacagggttgtgtagttcagtagtttcagtagaaacggtacttcaagtaactacacaaccactctgtttttcactctatttccttaattatttcaggaaataaggctaaatgaggtcataagtgtaaataattaagaataaatgaggtcacaagtatggggccctaatccaataggattggtgtccatataagaaaaggaagagacaccaatgatttctccttctttacatacccagagtaaaagctaagtgaggacacagtgagaaggtggccttctgcaagcctgaaacagtggtcttgccagaaaccaacactaccaaaaccttgatcttggtcttccagcctccagaaccatgagaaaataaatttctattgtttttgctacccaggctatggtattctgttatggcagcctaagcaaactaatacaacccccacaccaattcttaatctctcagttgtcttttcctctcattgctgccacccaatcttttcctggaatctgaaccttaggtatgcaaatagtccccaacttacatggtttgacttaacagtttctaaactttgtaatggtgcaagatcgatacacattcagtagaaacagcacttcaagtaactacaccatcattctatttttcactgtcagtattcagtaaattacatgaaacattcaacacttttattataaaacaggctttgtgttagatggttttgcccaattataggctaatgcaagtgttctaagcagatttaaggcaggctaggcgaaagctatgatgttaagcaggttaagtatgttaaatgtattttctacttatgacatcttcaacttaacttaaagatgggtttatcaggacataagccccatcataagtcagagcaccttcttgtagccactgaaccatgccccctcgcttttgaatcaacactgtcatctatccataactgctaatttaccttcactaaaatgagtgtctaccaatatctacccctcatcctccaattcccatgagaccagggcaagcctttatcatcatatacactgcttcaaatctgtctcctcctccaacatgctcatctttatataatggctagcttcaacttcccaaaaacatctcatgctatcacttgctcaaataccatcaattgtatacatacagaccttcatttaagggcctttttaactttctaatccatccctaatgttttctcccaacttctcaagccaaaaccctgcataaggtcaaaatgacccataaccatcctctgaatctgttgcattattttatttacttccttttttcatatttttcttttattttttagacacaagttcttactctgtcgcccaggatggagtacagcggtgtggtcacagctcacggtggcctccaactcctagaatcatgctatcctcccccgtcggccttccaagtatctgggactacaggcatgcatcaccacacccagttattttttattttttactttttgtagacacagggtcctcactatgttgttgagactggtcttgaactcctggcctcaagcaatccctccccgcaaggcctcccaaagtgctgggattacaggagtgaggcaccactgcctggcctgtttccttgcttttattcctattgttgtgacaatttggaatgtcctctctgcttatttcctttctaaatggcagctggaagaaagaagttctgaagaacattacacaatcacaaggggcttgttatggcaaaaccttctaccctcaactgctgctctgccacatactgattttattcaaataggcttttacctccaccaaatcatgccaggtacttacacaatatctgaaagatggtaccaatttcagctccacataaatagaaaatgggaagatctgacacaaatgaaattcagagttttcagaggctctcatctccccctaagtattatcatcctaagtaaggtctagagaccatgagacacacatatagatttgatctgagctcaatcagttcttctctcaaaccctcaactttttttctaaagctatcacctaaatcccagcaacaaaactaatagagtctctcagattttcccaattttcaacgatcccctcccctatcattcctccaaagaacatcataacaagcctcttcaacactctctttatgagagcctgagcttcgtaacctatactggatccttattgattttcatcatgtgagtgacaaaacacagtaatatactaagatttccaacaacctgaatacctggctcttgatttttacatgcccccaaaatagcctctgtcccactcagtggactttccacctccaaacttttataactattttctccactcatgatcttctccctactggttccaatttacacgcatgctcttcattataagctttgctgatcttctctaataaattttgcttacccctttaaaaacagtcctccaagagctctttcctggtaacttagcatgcactatatcatacagccatttgtaaggccccatcaatgactccacctgtatgtggtcatctttatatagaaacccaaccagaatggagacataaaattctagaagagctttagttctttcatcattgtgatctaaatcaaagggcactgcagtcagcagcacccagagatactccaatgtcactgactagcataccaacagcattcaagctgcttcatgagcttatctttccccttctaacttcagggttggtagggcaaagaaatgacaccaatgacatctacaatcagggcctggaatcaaaagcaaactgatagtgtaacattcagggacttcagtgacactttcctagaacactgagtgcccaaaagggctgggccatcagcttcccctaaagaggggaaaagaaccacccactttctacaacagattgactgttaaacacacgtacagcaggcctcttgcaggagaaaaggcaagctgtcctgccagagttcctaaaagcttctgaggacaacaatttttcttagggagtgaaaatatataccctaatccatactggatagacagcccccatttttcaaattcaaggctgaataagatacattcagttttaaacattcctagaatttgagaattccaaagtatcaaccatttttacatcaaataactacattagtcaaaccagactaattattaaaattacacaaagcttgtacaaatcaatccttaatgtttaggaaaatcatgaaaaaatttgtgtggggaaaccagtctaatcttttcagatccagtacaccaaccacttggcaatgctccctacaatctgggaagatttcctgaccaatggaatacagataaaatatggcagagtatgcattaatccttccatcttctcttgttttaataataagtagagagccaggaccatacaaattaggtatatacagctcctagaaaaataaaatttaactaaagctaaagaagatgaacacttctttaaccaaatttcccaccttattttatcttatgcacacctacaaaacatctgtatacatgccttataatagcttttgatcaactgctatcaaaacaaactaaaggagtaaaataatattactgctcttcagacattaaaaaacacatttctaagcaatattttcaaagtcaacaactttgaaaaattaagtccttatctttatagaccacaggctcattataattaagtgggtagtttgtttatattttatataagattccctaagaacctaagatcctgccagtgtctatttaagaaatggagaaaatgttgggcgtggtggctcatgcctgtaatcccagcactttgggaggctgaggtgggtgggtcacctgaggtcaggagttcgagaacagcgtggccaacatggtaaaatcccatctctactaaaaatacaaaattagcttcgtgtggtggtacatggctgtagtcccagctactcgcgaggctgtgacaggagaatcgcttgaacctgggaggcggaggctgcagtgagccgagatcacgccactgctgtccagcctgagcgagacagagcaagactccatctcaaaaaaataaaaataaaaaataaatggggaaaacaacattgtaagtactggaaaatactacgtccatagtcattgatatataaaatgtctcaaaaaataggactgtcataaaatacagaacctcttacagagaagaaattttaagttgccactattaaaatggaatttaaaatctcaagattccacatatttaagaacgaatattcctttgttcatcacaaagctgagacaaaaacaagacatttaatggcaatgtgtctcctccctgaaagttgattttattgctatttagcatttccaggaaataatttctaagagctaaacaatcatttttaatattgactcctcttcacagcccgctctgcagcaccaccaccttcttacaaaccgggggaaaaatgcataagtggatgtttaaattactttcttgatcaatattgtttcccaccagattttggaatattatgaaaacgaagtgtacccattttggtccttggaccttcaattgtttcttaatttttatgagaaacaaaaatttgaacagtaatatacttctgcaatccaaagaagaattaaaccaaaagacaaatgatgaactttctaggtcctactataaaacactagagttagaagggtgatcattgttaacatacaactctggttcaagccctggttatggggctttcactgggttattacagttcttgttatttacaaatgtggaagcttattacatataaaagctcttacttctaataacctttgggtaacttgcaatctccatttaaaaagcctcttcctcacaattactgtccatttgaagagcgatttgacccatactctgtcctttgagacatcacataaaaggactctcacctactcaaaaatcaatcttttcagtcagatgaaatcttaatgaaagctgagatcatctcgaggaaagcaaaatactgccaaaaggcaaaaacagcttcacactctaacggtaaacccacaaaattgccagattaaaattctgctgcttagtcattatgatccaaagatgcatgacttgcctcactagggcaatggctgtctataagtaagatatctagagtttacaccatccttacggagagccttgacactattattgccaaatctatacgtagagttagttccctgcacaagaagatatttaattatagctctataattttttttcaaaacagagtaatatcccaaatatgtaaaagatatcctgagaacaattgcccttgcccttcgtcctttgtataggttattctactgattcaatatcagtcatggaatatactagagaaaatagattctgacttgcttatctcttcattttaaccccattttcctcattccaaatagtaaggatgcatttgagagatagctaactataaagaatgaggacagggacaatggactgcaaagctggttgatgcagagtccaactcacaagcatgacatggtagccaatttagctaaatggacacaggttgaattaacctgacctttatgcttcaatgtcctaatttgtacaatagctaccatctgcccagctgagtcctgagcagctaacaacaggatttgaagagtttaagattcgagacaaaaatgaaccaaaatccagaatgaatcctactaattctacttaagcccaaaagtgaacctctatcctctgtttaaaagaaaaacacaggcgttttcaaaaaaatacaaccagtaaaggcactacaaaaacagcacggctttctaaatatcattaaactgatcttaaattgtaatgcatgctaagtccctagcacatcacaggaacagtgtaaatataaacacaaactaaatgaagaaatgtgtaagtcatcttcatgttatctggtaaatctcatgtatgatacacttcaataaaatcccaaaggccagctattgggaatttaaaacagaaagggtgcttggtagcaggaggggcatgggtggtagataatgacagaaataattaaaggtagggactgagaggagattttttaaaggacaccaggtgtacgatttaggtttgccataatgatatacttgagtgaataaaaagtatgggatgcgggcgtggtggcttacgcctgtaatcccagtactttgggaggctgaggcaggtggatcatctgaggtctggagtttgagaccaatctgaccaacatggagaaaaccccgcctctgctaaaaatacaaaattaggtgggcgtggtggcgcatgcctgtaatccgagctactcgggtggctgaggcaggagaatctcttgaacctgggaagcggaggttgcggtaagctgaaatcacgccattgcactccagcttgcgcaacaagagtgaaactctgtctcaaaagaaaaaaaaagaaaagaaaagaaaaaaaaagtatgggataagaattcatgggtcatgatcaagagaaaaagttatttggctagttcatgaagtaaacattgcatccggcaaagaagggagaactctgaatgcctgaaagtgtttgaaatctgttctgtaagcaatagggagccactgaaaccttcaggcaggatgacagagccaaagctgtcctttaactgtctcttacaagattctaactcaaatgtgcctaaattctgcaaggttatttatctgaggagacagttcataatattagtgcaaaaaggtcgcaacagcaaaacaggaccctttatttgattaaataatttagttctaacacctgggcagagagaattccagtatagatgttactgtgcactctgaagccagactgcgtgagttctaattccagctctgtcatttactgcatctttgggcctgtaacttaaatcactctacgtgccatttccttacctataaaatggcgggggtggggagataattataccacctacatctcagagttttgtaagaactcaagtgagtgaatccatgtagactgctgagaacagtgcctggcacagagaagcagccttcaaattatgctgacacaaccacttctatgccataccctttgacatctgataaatgttactgtaacatttcatataaagtatcagaatatggattctgcctttgtagggggtgtgtgtgggaagggagacgagggaggagtcagatttttctgttcctatccttcaaaaccacaagctaaaagctatacacctaggtgaacactttccatttccaataggccttgtccatttttcccttctcgatggtttaaaatggttcccaggcacacgtgtaattaaattcattatcttaaaaaactgcttcaggaaatgcagcaatcaaatctgccaccatctgttttttatagatagatataattacaacctaataggcatcatttaatcaagacttaacaattaggttcttaaatccaaaacttgatcattttcttccttgatatgtgtacaaaattttctcccaggtggtggtcatgtaaagtgaaggatggaagaactattaaaacccttatcataatggccttcctaaagtgctaattattacacaattaagacagacataatatgactagaaagcctaagaaaatctaatgcaatctcacagaagctttttaaaatttttttccatctctatctccaaactacctaccaaaaaacccaaaatacaaaggagtacctctcgcctatgacttcttaacaagcgaagtcaggagtagcaccaaaccttcccctggttctaacatcacctagtcagatctttagaggagaaaagcaatcctatctgttaccttgtttcccatcccgcattttaagagataagaaacccaggacctgaaaagtgagtattttcctaaggcactcagggtgaaacctggactagaacctagatgtccctccataaaaaacaagattttgtactcttactccaccccaccacgtgagtggggaaaagcagagttttgagggcctacaatcctcaagtctgatcactgggtctctcacatctaattacaatatccagccccatttccaacttaataagattaattctttgtcactgatgctcaatagtaactcttgctactcccagcagccaacaccctagtttgaaagacatgcaggtcaccagtgcatcttctattgagagcccctaattgccttaccacacccaaggtgcttcctgctagactaagcttctttacagacctaacacaccaaataagagaccacagttgggcaagaaatctattaagaattagaaaaccctgaaagggctctatttaccactgaaaagaaaaatcttaagccctttgtagtttcccattctctttcctttcccaaaagctttaagaggtctcccagcaaacctaaaccaagccctcacttttaaacacagctgtccaaggactctgtgggtgggtgcaggggacagacctaatctttccctatgcaagatttgaagagtattagagaaacaaagcattaaagaaacaaaagccttaaagtccaatatttctcctaaaataacctcattaaggcaagttttctttggtcttccaaagaatcccaattcaaaaatgagaaaagaaagtagctaataatgagggcttcaccataaagcatcacaatcaacctttcattattcccattctgtaggtcagacatcgaaggcttggataggtggagtgactttgaatagggaccccaaattctgaactggaggtgtaacaatcaagtcctaaaacagtagagttcctattcctcttctcagcttattttaacaccaaatgtgtaacccagggtatctgctcatgcaggggcctaagtgcacccttcacaacccgggatggtagtgcccaagagcagctctactaagccagaatgagcaaatggcaccatgcttacatgaggagaaggacctcacaagctgcagaacatgtccagcctagcccccttccctcttattcaaggatgaagtgaaatgcactacagccctatatgcttaagatatcagatggaaattttaagaattctttcaaagaacataggtcattatccccaactttggaaaactacttcagattacttggttttggggagtagagaatcagtatagaatgcttctcaagcaaatgaatctacaaaattagaaaatttgacttacttaaaataacttacagtaaaagtttaaaactaaactttaaatttagtttgggaaaacagatgacgtatgaaattttttattcaaatacgaatttagatctatcttcatctgatacgggtgccttcaagggcaatgagccgctttttaaatctcctcagaggatcctattcacattaaacagaagccacaggaaaactggcattaacatttccttcctgcttgttggaaagcaaggcaccttatttgagggctttccagatcaagaacacattttataccaataaactttacagctgggcccagcagagatctacaaattaaggctaattgtgaactgtacagcaactgtccttcgtcttccatttttatattttatttcaatttggagctacctaacagacacagaagccctccagactatttctcaaaactttctgtttggaagtaggtacacgcacccaggaatactgaagtatgaaataaatattaagagcctagaacaaaatacaaaaacattactggaaataggctcaatatgttttaaaataacatttaaaacttaactgctgctttatttcttttaaactcaaagaaattttctcaggtagaagattttttaaagctacaagggatttcaaaatgaaaaactaatatttcttctcttgaatgttgtgcttgaaaggaaaagttatactgtcattcattcaataaatattaagctctacgtacaggagctattggaatataaagtgtgtctttgccttcaagggctactcagttttcagacaagtaaatttcttgcaagcagaaatcccagagtatcaatgatctcaccaacagaagtgtcctagctaagggactttagttttaaacagaaatcaacatcattaagaatgctagatgtcactgttactgacatttcttgatccagttagggtgtataaaggtcaacatctgacaacagaatgttcacgcattagttatccaaactaaaatgcagaaaatgtctaaatcagcacatttgaaactagaaagaaattaattctattacaatattaaatgtggaatcatacacagaaaaataaatgggcacccttcactaccaacaccccattttgcattttaaagggggaagggactcccacagagttttcttctaacaagcgctgcaaataggaattgacaggtggagccctgattgacaatggtggttttagatgacacctcacctccctcctccttacccacctaatctcacgactaatgcgggaagctgaaataaatacagtggaagattgtttatctgtttcgttttgtttttttaagtgcagatgtgttccacaattgaagaaagaggttaagattctatacacatcctgggtaccatttagtcaatgtctacttgagcaacaaactaggacaatgaaaccaatacaggaagaagaaaatgcatggagcaggtgaactactccgaggtgcatttttagctcatgtgaccttccaacgtgctccaagtatgttgtatgtagatgtgtgggcatgtatttatagaaagggtcaagagcgctataaaaaatacattaataatgttagtgctacaagggacttccaaacgctagcccacagcctcaatttttagacagagaaagcaagccccaagacttggccaaactttctagtgatagaatttgctagtgatagaatctggtcatagcattcaagttttcaactcctgaagacaatcttacctccaaagtactccaattccacagctttattcttaaatttacccctcccctagaaagatgactgcccactcctccctacaatacagattccaagttttaagactcagatgggcctagccctgccttccaagaatccattaggctaatccagtggttctcaaagcatagcctgggaacctaagagtcctctgagacttcctcatacatccgggaagtcaagagaatgccttttcctctcataaatgtacagtagagctttctaaaggttatatgtgacacttgcttctgcattcagtctgttgcaatgagaatacagttgactagatctattaagccagacgttaaagaaatgtaaaatgtaaaactatgccagccttactttttaaaaatatacatattcctcactttaaaaatattttttaatatgtaatgggtttgctatttaaacaggtttttaaactttctcatcttaatttcttatacagtaaatatttatacacataacaaacaaaaggtcctggggtcctcaataatttaagtgtacaaagggatcctctgatcaagaactttgagaattactggtctaattcactgctacataagcatgcctttatggtgaatccctttagcccatatagataaaccttagaacagcttccaactactctccttaccttcaaagggatgttcctccagctctgggactatgtaaactacttctcatgcccagtactaccctgatttataagaaaaaaacgtgaatcatctcaactgcctttaatgtaaaatttttacataaacattgtcggggaaacatgaatataactgtatattctggttctcagaaaagatgctttataaagcataacaagctattacatgtttcatgttgcatacttacactggtttagaaaaatgcttgagtatcttatgagtctctcctacacaatacaaagcatgccagaagcagtttttcactttcatttgggggtttacaccctagtcaggaagccatgcatgctccatcttcctctcaaagccctggtgcgttcctcctcaaggcccctttagccacatcagcccatgtcttttgcttcagttttcctcacactaagccatcctgtaaaattgtcccaaggctggctctctcaaacaaaataagagaaatgttcctgtatggatttcagtgtcctctagaaacccacccatgttccaataatcaaaactttttccttacatgctaggagtacaccacacttaatcctcttctcctggggggttgcgggtggggtggggggacaagtccccctatctgtataaaagagcttcacaagtgctactacatctacctggtttcaggaaccttttcccaatgtttgcagcagacctcaccaaactcccataaactcacgttttcttcctctggactgtcaaccagacttggagaacttgagagtggcatccacatcctagtgtttctgagcacccaacgaccatgcacaacgctcagctcaaggcaggcactgaatgctaacaaacagctcatatgtaggaaaagtgcaaatctattaaaatgctctgaaaagcccaagggggatcagcttttgaagtaattagtaattctattataataatttgtgcaaattaaaaaatatatatttgatgcaaaaagataaccacagaactgtttaaaagatggatttattatttatttatttatttattttttttttgagacggcgtctcgctctgtcgcccaggcaggagtgcaatggcatgatctcggctcacagcaacctccacctcctgggttcaagcaataaaagacagaaatatttaatttcttcaaatctacacctgagaggttaacaatttcatgaacactttgaacactttcaaagaaaatacaaacatgtaatggcacaggtgaggaaaagtaaatacttaatacatagatctttttgaatgctctctgaaccttgctttttacatttcaagatcagcacatactctttatttacagatactatataatagagatatataccctgattaatttaaccaatcccctactgatgaacattccaaggttttgctatttcaaacagtgcttacaatagataccttatacagtaaagcaaaaatgtaaatttaaagatagaaattgctggtttgtagtctatttgcatttttaattacgctagtcactgccaaaaaaaacttctgaaaacttatcagtttgcagtcccaccaaagcataacctacatttttaaaaaggaaataatgcagcagtgtagagagggcactgggggaagtaaaggcaagtcgggaaccagccacaaggtcacagtcaccaaccacaatcattatacctaagactttagacaatacatcttagcatcagttctgaatgtatatgaaatgagactgctgttcaacactatgggtagggcctttccagctctaacattctctgatgtccttgaacttgttatatataagaaatgtacattaaatatgaagacagaatgcttatcctcttggactacccaaggacaacaaataaatgctgggaaagtcagctgcaacactgggaacataaatgctctgacaaacccctgctaggaatttcaaaatggaagtgaaattgagactgaagaaaaagaccacctaataggaaatataaaaagccatttcaaaaatgataaacaaaagaaagacgttaatcatttggggattttcctagtttaaaacaaaccacatctccgtaaaagaaatatggctaaatggctataacaagtaagggccaaagcaccctcatggctactaataaataaaacggtacaaacatccctttcaagtctaccatttgagagagtggatactaacaagagatatgatttgctaagctaaataaaagccttcattaacaagaagtgacaggatcacaaccctgctgctgataaactgccaacatacccaaggtcttcaatgaagggttgcccatttaacatactgcagctttaaaatgagttgctttagaacgaacagttctatgtcaaggcaggcctacaacatacaaaacagatggagctgctactgtaccttgggcttgtgtgtgtacccatgcacgagcatgagcttggcatataccacaggagaacctggcccaataacgcttcttaaagttagccatccatgattagagcatctaccttagacctcaacttctctatctgcttccaaagatactcagtgtagagcagaaaacattcttctgatagccgaagagggttccacatggctattaaatgactggcccagtggtcatccatggagacccctccttattcctggcaaacacagtcatttcagtccaaccttgaagcagccaatatcttttcaatacagcacactttgaagcggtattaacaggtcataaatacatgtaaaaagcatagtttcagcttagtcaaagtggttacagaagcatcattgtatatttttttctgggtggtccaagtaaattaaactcaccaactagactgcaaacagataccataaattcttaattattcacaggtatggatgaaaagaaatagcactttaataaagtcatcttaaaatattattcagtatccagcacttaattaccatcatatagtagtgatatctaaaaaacatagaaatgtttgctatagtttaaatattaacaatttttattaactccaattggttaaatatgtaagttatacaacttcatagcaaccaaaataccaaggccgaatacacaattaaaagaaaaaaacttgcatgtaacatttaccttcagcatatataattttaatcttcattttaaagacataggacctattagattcaagaaatcagactagccaggtgaggtggctcaggtctgtaatcccagcactttggaagtccaaagcagaaggatcccttgagcccaggatttcaagacaagcctgggtaagatggtgagaccccatctctacaaaaaaatttaaaaattagccagttgcagtaaagcatgcctatagacccaactactcaggaggctgatgctggaggatccctaaaagcccaggaattcaaagttacagttaactatgatcatgccactgcagtgagactaaatctcttaaaaaaaaaaatcagtaataagacaataagacccactatattcagaaaacaaagttataagaatcactgacatcaaagagcttccaatgtagttgaaagtaacatttaagttgtgccctgaaaatttaaaccaatataaaaagctattaaggagagaccagacaccaaaggcaatgggaagttgttaccccaagtgcccattccgtaacagctccttaactctcatacctgctgtccctgtaatgccagaagtaaaattaaaattctcctctcctgaactaaaacttggtttacttctctccaaattccatcaagagtagaggttactgtctatattttcagtagcttccttctgcacctaaggaaaaggggctgaaatctaaaagctgtgatgaaataatatccacctacaaaaaaatgctatatccatgttaaatcaaacaattataaatggtataagctaaaaggcatgcaaagtttttattatcttcctaaagaccagcttatattaaaaataaaactgtttgccagagtccacctctctgaggaaactaagagcctagtcaagtaagcttaataatctaataaggtggtcagaaagacactattttaaaatatcatatccttgccatgcattcactgtactgtttaggtctggtgatctgtgtgaatgaggaaactagccagatggaaaattcacttcctcattttccttaaccttttttccgtgtcttttccaattgcttagagtaatttcccatattctacccatctcttacgaacatacctagccctttaggattaaggaactccacagaagccactgacatttttttaaaaagtatttttcgacactcttaaacaacaaatgtcttccaaagtttctacaaaaaaaaaactgcctaagtctcttccactccaacaaatattttaaaaacaattccaattaatatggtatttccttttagttataatttaaatgaatactggaaggaacacaatatggtaaagcaatggggtgatctgtcaaagggattatctaaaaggtcattcataaacaaaccaaataatccaatcaatgacaaaacacaactgtggatgaattagtgaaattctaatttccgccaagcaaaaagcctaacaaatattcctaagttcttactgcatcaattaatacattagaaagtgttatttaaacaaatactgataatatttcaaaatccaacacattttcaaagccatgggtaaagagaataaaggatttagacaatgcagatctcactgctgggctttgcattcaccacatagctttcagagtaaaagttgccaaattacgttgtcctgcaaagaacattaaaatcggtttctcgtaaaaaatataaaaagccagatccatggtgggatagaagctgggtggcaggaatcagctctaggactcaaagttcaccatcaatttatcaaggagaatagagtttaattttaggacctctgtctatccttatgcctataaaattaaaaactagtctgtttttatgtacagtaaaaataaggtagctaggaaggaaatcaacaaatgatcttcactaatcacctcccacactgtgttataagccttaaaggttattttccttcacagcacaaatcacaattatatgtaataatttgtagaactttaacataatatctcctccaataaactctaagtttcatatcagcagggagtatactgtattcactactatagtcttaatacctaaggtagtatatgtggcatatagcaagatcacaaatatttactaaacaaatgaaaatctgcacaggaaaccaagaaatgttcacatgtaaactggcaaaataattgcttttaaagtactggggggcagaaaaggctggatcagcaaatcaaaaactgaatagaaggacaatcaaaaagagcaaaatgccattcatgtcaggaggccagacacaataaaataataaaatgttaaatgctaggaaaagagagataagtttaaagttttaaagtggctactaataaaaactttagatgtaaacatttcaaatattcataggctatttaataaactgtcatcaaattgccacatttctttgagacgataacagagaataatcacagggaatgagagagagaaagaaatgttagccataatgaaaaattccttatgggtaaagttccagaaaattccttaaggagtctgaactataacacccaaaacttaacaaagtccctggatctcttaatgcttctgaattccatagggaactggggagctacaaagcattttacccaacaaaatctctggtagtcttcgccaaatttaaggaaacacaacaaaaattaaagagaaatgatacgtattaaggtcaaagtttaaggttactatgtcctataaaatgtgatgatgagtaaaatgctattgagctttcaccctcaacaattaacttctgcttcatcctgtgatattctaaattacagctaaccagtacggagcagccttgtcaggatcccacctgactgctttgtgcatagcctgttggccaattttataccagaggcacctgcttgaaatatgtagagacaatctgatgaccttattttctcacgtttacaccagctttccatagcacaaggacaatatttatactctaggaagagtaaaatatttgcagagataagaaatcagagaacatgttggcatgaagctatttcagcttctcaattctaagacatttggactgaaagatgcacccactaacctcacagctttgggggacatagaatcaggacattaagtaaacttaagagactcaaaagtaatataaaaattgcatatctaagacatgagaaaacatgggattagttaaggcagtttttgcaaaaatttccctgtagagattgaaattctagtaagattacctatcattcatgatttacttacatatgcaaataattttcaattgattatcagtctcatgtactatattctttctttaaattattatctctattccagacttttgagttctgctgttccagtgacctccacaaattttcctgaatttctcctaaaaacacactatgtgagagatcaagtaatgaaaaagagcacatggcctctttctagggaagagcaaaaaggtcattttgaatctgtaattctttgtcatccactcccaaccaatttttctgacagtaaagttggagaaacagtaaagttggagaaatactgaaaacttactggagaaaggtgaatcaagaacaatctttactgggtgaatattttgtttattccaatttggatatcaaacatcctattgaacacttgacctgccatttttttctcagaacaaaaagtagtatttctaaaatcctgcctgattgggaacacattttttttcataaacttaacaagttcaaaaaacagcccttacagattatctactacaatgagccagggttatctcaatgtcactttcacctttttcttgattttaacagcatcctaaaaaaagcctgaagacagtgtcttcatttccttgcttacagaaaataaccaatccatactttgtatggttccaaaaagtaatcctgcaagtcaaggatgccagctggcatcagaaagtcaccagcctgtgatggaaatgcctccagaagtcacccagtcatggacctaaaataatccaaggtcagaatcctggccctgaggaacaagttgtgggcatactgctaggagtgctacagggaccacagtgaagctttaaaaaaaattataaaaataaaaaataatcctggtacaacaaccccaccactggggaaccaaacagcctctaaagcaatttaatatggaggtgagatacaattgctgctggagtcacaccattttatttcaaaacacccctaagagaagcaatacattctcaaacatgaaaactgagttgcttcttggatctgatttcagccaccttaaactacagccagcagaactaccaaaagtagaaagaacatcattctgggatccatggaaagaggtacagaactaggagtctgacctgatcctacttccccacttggttgtatccttgggcaaaccacctgacctctgagcttcattttcctcacctataaaacatcattcccagggagctgtggcaagtttctataaggacagaaaaacttggtgttaatcaccattactagaggaaatgctccgtgtctcctggttccatcaccttgtggtagttcaccatcttcaattgccaactccacgtatttttctatcttcctaatggtaagtcaacaactaaaaagtggcagatccctgctgccccatcccaatccactgctaacttgactgtccaacacaaaatttcttactgttgcattctcaagggagagtcatttggaagttaccatagaagttgtacaaaaggaaaaccaaaacagatgtcttcactcttcctgtctaggtcacaaactattattcactctaaaaccaaagatttcaccctaccatccacaaaacaatgtttataagtcagccaaactgtttgggaaaaaattttttcaaaaagtccaagaaacaagaacacaaattattccccgaacagccagttccaactgaaggaatgagcctctccactaaatcaaaaaggtaacgcagcgtacaagctgttcgatcacctttcaaggaaaaaaaaaaaaacccacgaaacagtaatgcaaatgccattaagggagaaaagcagtggccaggcctcagaacaccaagcactggcatgagaaagccatagtcagcagcccagacaacacatgctcctggaagacatggccttagccatgaagatgacgcaaggagaaggcatagatcaatgctctgaaaagcaccccagcttctgtcctgttacttgcttcttgctcctgcaactatattcccaaaagggaggaagtcaaaaaagttgtaattattttgactttttcctaggtgttttgaaaaataaatgttatacccagaggaggctgctggcacataatgttgtcaacagaataaaactctgggggaaacacccagcttcatgtagtttgaaacacaacgtgcctcagatctactcttctgggacaacagtggaattaagacagtcacagcttgtctctctctagccacaccctcaaacttgagtaggttttgcagaaatacttttcacctgtgactgagctcctggcaaactaggaaatagttactcataccataaaagaaaatcaaaggtaacaaaaacaatatgggaggaacgggggagggaaataagacataaaaagcaaaaaatagacaaaatggaccaagaaaagacacagtcctgtccctaaagcaataagcaacaacctggcctgatcccttgattcccagacaacagggatatatctctttgcttaattcctcaagcactcagtttctactattaaatgcaagagtggggagtgtgtgatttttttttaagttatcattttctgcctcatctccttaggtagagaccaaggaatatgaggtaaagggcactttatacaagtctcaacgttctcagtatccagcactcagtaatttgtgatgaaacaataagtattacacaatcttcctggcttctgaacataatctcaacacaaaacctagaagaatatttttattgatccttcaacaaactcaaaaacaaaattagattaatttggaaaagccctaagcttcaagttaactagcagcccacatatatcaaagtcattcttattgcacagtagaagctccacgggaatgactcccaatctttagggggataaaacatgcttgtttttactgatattcaattccccaccccaacccagtaactaagccaccctgaggtgccgcaatgagatgctgcagggagcatcaaaaacaagcaacacgttcacctaaaagaatcatataatcatagaatagaagatgcttggtaccaagaatttttaagtgcctctgaaaaataagttccaaatgtacctacaatgattttttaaaatcatacacagttaattcaaaattaagtttttaagtgagcatacacttatactaacactccaaatatcaaaaaaaaaaaaaaaattggctgggttgtagagtaagccaatgcttaaaactgccaacattaagctattattctgaagggttttgctaagatgttcaatacaggggcacattctgattcatcgttataactggcctagctgaagtggctgccaggagagcagggttttatgggcattgttccatcctaagaagctacattaatgctgggttgatacaacagatcttcatatctatttaccaggctgaacaaaagttaactagaaatgtaagtgcttaaagtcaccaaaaggaaggctccacactgacattttctacctacttagcattcaactatattcatctcactagacattaacacacaccaaagttgctctctgctattcaaattgtgctattatgctcaggagtagattaatattatccaccttccttattgtaaaataaaattacagcattggtccaaacatgacatgtggagcctctttctacttctgctggtgcatcagtctgctctacggcacacataggagagggccttgctaaggctgccctgctgcttctggagtgggggagaaaaggctgaagactgaaaaaaataaaggggaaagggagagaaataacacacacacataaaccacacacctggaagtctcatatcggctttttttttttttttttacaacaatcttataaatctgttgtcatttataagctcacaacatcagcaatgaggttagcaggtgggccacaggcctcttttaaacagctcataacatcctatcagtttttacagcatcaagtagcaatgttgaccccaaagcatctgaataaatagaagcaggcaactggcagggagaaatccctactcccaatggggacagttctaaaatcccagggggggaggagagaaaaggtaagttaagctgagagaagctcattttataaaaggagaaactgtttttcaaccacgggttaaggaaggagagacccaagacaaatcttctctgaagtaaaggagactataagatctaaatatgtaaggagcagtttaacatgattcaaacattatctgtaaatacaagagatcaaacgaatataaaacctttagaactactgcctttgtctttacacttaactttttaattcacgtggctttaggaagtatagcattagagacaccaaggccaggcaaacaaaccaaggtcaaagtgaaacaagccatgcttcatccttaaggcgcagtcgataaatgtggactccattgttgttgctccatccttccaagttttcaagaagcaatacatttggctccagatctttatatattaccaaaccgtaaatcaacaactcacaactatttaaaacacagttcagggcaatcaaaacacctataggccatatgaagctcacggatcacccttcaggacctgtggcacaaataatttgtccactgataccaactgctccttctggtatcagtgattcacttggtcacagaagatattcttcagtaagtaaaatgtaacaaagtgcataagagccaatgcaaaagcccaagcaggataagaaaataaagggacaagtgagcaggttgcacctgaccccaaattaccaggacctggaactaagcacaaggctaaaaggataaacaagggacagagggcaagtacagacgcatcccaaagaggggaggaaggctgtgggtagttcaaattccttgcggagactatggagaagggaagagatgaaagtcaaaagcactgatgacctcgtatttgggaaaagtccatgggtcattcagaggcacaggacagaaaagaccccaagggtttttaaacaaaataagccagcaatcagtaaatagcacctggggagatcaaaagtggtgttgaataaactcaaatagaaataggccttacctgggaacaggttataaaatcttgctccctctataataaatgttgtatatttaacacattctggatacctctgcaataaaggtggatgaccccctcacctgccatatcacctccaataaagcaatatcagtataacaagaaattcttacttttgaaaagcagctcagagaaaacaagatcaagtgctccagaaatattttcccatccttacccaattcactgaatttattttcagatacactgtgatttgctttattctgatatacacaaatgatgcctaaagaataaaaaaagtgctaaacatcctttaaaagctgaacaagtgagcaatttccaataacttacttgacagggcatccatcaatgatgttcacaccatcagcaatgaggggaaaaaaatgtatttctatgtaaactccattttgtgatgtataggaatggatccttgataagaggttaaataaaattcaaatcagagaaaacgcggactattttaatataaatggttaaatttaaaattttgatttttcactgaaaaaaatatgagaaatttaaattaagaaatttatattcctggaatgttagctggctaaattctcagtctcatatgtaatcttttagcattatttatattttcaaggaaaatgcattttaaactttccaagtcccatcatcataggtataaatatgtctatttccatactgaaatgtccaaagtcacaattctcccaaatcctccctgcagtctgggatttttcttttacttcatggcagaaataaacatatgatggtgtattataaaaaaacaaaatcactaaaaatggttcataacacattgaaagccaaaaatataaaactaatcaagcagtaaccacctactaccacctttccaattcagtcaatgtcatttcattgtcaaaaaatcttgtacttcaatatgctcatctttacgtggtccttgagatggggagggtaagattttatacacaatcaaaggttaagaaaccaaggatataagtaattaaaccaaaccagatgctgaaaacttcagacttctagcctactattttccacctggctgtgctaaattaagaatttcaacctaagtgacaaaacctactgagacaactcagcaaattggccgcacgggcacggtgatcacaagaccttatgtgtgtgattatttgtttacaaaaacagaatggattttaaaacaaactatgagacaggaaagcttagagtcagtcatccttcaaagaatgctaaaggcccacatcactaactcaacagcagacaagaacctctgaatgacttcacccagttctcactagtataagaagacaactctaattgccaaagtcctatttcccaaatggaacctcattttaacacgctttcttccaaagtgcaaaatactaaaaactgtatggaaatttcttatttgtatatatttctctaggaagagacagctacagctttcttcaaatgcttaaagagattctagcccctcaatattaacaagaacttccaattttacaatgactctaaagaaatgcaggaaagctaagaatctcaaaacaactatcattccctagtcccataaagagatgaaattagtcaagaaagtgtgtactaaaagctttcagtaaaaaaaaaaaaaaaaaaaaaaaaaaaaaggggataaaaatccatcttgaaggaatagtttattgctttgatatttataaaagatttttgtgatatcctattaacatagtctttaaagttgctgaaataatctccaataatgaacaacccacaaaaacaaaatgctggaagaaaagaacatttagaatataaatttccctttcatgataaactttttaagtcaaaggaaaaacccaaggattaaatctatcactacagatggtccccaatttatgatggttcaaacttacgatttttcaactgtatggtgatataaaagtaacacacgtttaggagaaactatattttgaattttgatcctttcccgggctagcagtctatggtaagagactctctcgatatagggcaatggtagcaagccacagctcccactcaggcaatggatcatgagagtgaaaaatggatactctgtgttgccagatgattttgcccaactataacataaatgttctgagcatgtttaaggtaggctagactaagctctgatattcagtaggttaggcgtattaaatacatttttaacttaatgccattttcaacttgcaatgggtttatcaggagcatctgtattagattggccaacggaaaaatatacaggtacatcaaactgtagataacatacctggttcaaaatataccagtgctaaagcaaaaccttcactgtgtcttaaaaaaaaaaacctatcattttactgttactgtcttacagtaagtataattttaaatttgtcaagttttttaaaatacatttttaaaagtgggaaaggggattttgcatgtcagaccttatctcctattcattttcagtcagaaactgatgtaatagatatcagtaatataaatatatactaagaaactgcaagtttatttaaaaaaaagacactgtaaggcattctataaactggtttagttttatccccattccacctattcttatgactttctgggttattttacctattttactcctcaaagcccccatccttctcttcataaagatttcttacaacgaaaacctgtatctgttgtcacacagaactattcagcaatattcaaaaaggtaccatgtcattaagcatatcaattcagttcacgcattgagagcctaactcaaagctctgagaaaagaatgctcgttgcaaaaatagttatttttattaagaccaatctctagaaacttaacattgatattaaagatgaagatgtctatgagaatgcatttagcacagcgttgctcacacaagagttaccttttgttttgttttgcacaatggaatacaagcttagagataaaaaaaattcttcccttgaaataaaaaattcttctagccttactaaaatgaaacatatgatacacatcacacaagctgaaagccaaatctgttaaatttactagtgaaaaatgtcctaagtaccccacaaaaatctaagattttattacgcaaactttgacttttaattcagactccaaaagttatcatttaaatcataataaaacacttatcttttaatatgtaaaagccttaaaataagcactgcctttcaagcttaagtgtcttctgtttccacttggcaaatttacgttatgtgaaatccttaaataattaactagcactataaaccgtctagtatctcgaaccaaataaatatacaataaatgttcttcccaaattagaacatacaaaagtgtggatttggcactgaactacaatatgtgggctctgtgcgtaaccagaaccggtgaagacttctacacctgtaaaatgaaaatggccaaagcaagaaaaaattttatgcattttatgtcctccatagtgaatttgatagtcaggtgtggcatcactagacataaagccttcaaacagttctataatatatcaacaaagcagcaatactgacagctaaatactaacaagtgggaaggcaactaaccaggaaaagctacgtaatctgtgggtcccagtgcaagatgaaaatgcagggtaaccttgtccaaaaattcttaagaatttcaagattgggtaggatgtgcaaccataccggttacaagctggaaaagcagtcctgcccataactaagtactcacgccaaaaataaaattaacctccccccacacacactcaaatgtggtagcttactatcatttttgacctgtccagctgagtagccaagaaacaaagagctgggggtagactgagatgggcaggttttccacagggtggcacaccatctagcccccttaaaatgtcaacaaaaaagtaaccaaaccaagctaagtaccacagattctagcctctctcaattccaaataaacattatgagtgataaaagtggcaataagaatgtgacgatgtgatagatttaataagacatcaaatgggagcgaaaatactgatgctaccatgcagacaagtcatcaaaaaggggaatggtaaagtcagtcttgataagaagcttaagaagctatttcagagtatctagtcctttggggaaaaagaacatgaaggctaatttgccactgtggtgctcttgtgcaatgccaataatgcctgaaaagcgtcacaggttttttaaaaaaatgtctttcagcaaagaaagaggaaaaggttgatcccagcttaaaagtcaggatattctggaaggctttgctgtgtccttaaagagaacctaagacttgcttctagaatagaagtggggtggcaggaggggaggcacattatttttaaaagataagcagggaaggctggaagagccaagagcggttggttacaaggattcagctagcagcatctgtctgtgtataaataatcaaaaggttgattcaaggaatgatggtatatgacactcacagcatcattctcccttaacctaccaggagctgagtcttaactaaaaccactgaaactgggacagaaaggctttgtttttctcttgtgaagaggcggtaaccagaacaaatcaaccaaaaaaactaaatcagagaggatctataaaaacacatcttaggcctagaaaagaaaaaaggttccatagtaaccttttgacactgagtgtcaaaagagtggtagacactgaccagcagtgggtacttgctctaaacaagaagcatatcctataactaaaattatcttgaaccacagggaaagtgtgtgagcactgaatatagctgacttgattgttcctgaaagaagacactacacaatgaaggaaacacctacagataaggaagagggaggggcttaacacctaaagttgtctttcaaaggaagaaaaaaacaactaactccctgaaaggtggcagcacaaagttacccaaataacaggcaacaaggggctggttttaaccacacaaaaataaaaatactctctcaaaaaggaaaattacaaaggaggaatcacagaaaatttaatgtaacatgtttcttcatattctaatttttcctaccccattctggcctttatcttccagatgttttcttcctcttctttctctccccatagtttgcaagcgaacttcccgtaagtatatcctccccacaaccttaagtgttgttaccttagcatccctacaaacctcctataaagaaggcccctaccacaaatgcagtaacattcgggtccactcagcaatacagtcaccatttatatatacccaaaggttactaagacaaggtagatgcaggacagcttttccacccgctcaccaaaatggaaactccaggtcagcttccacaagaaatgggaaattcaagcgactctggcgaaacgattcttgagaaaactcttcaagggcaacaaaacaatatttcaaacaaacagattttacttgagggaatggggacattacacagcaattgatattcgaatggttttaaatggactgattcgccgtaagttttgaggctgagctaaatttttatgaagaattattaggaatagggccactagaaaattaagttttaaaagcgcttttgtccttgccgaaggtattacattttggcacttctaagaaccgttctttgagggagggaataaaggagagtggacaactcgtagcaaatccttttcccatgttttcagaaaatgtagagacgataggacttgaaaatctttgtcataaagatggtctttaaaaatgcacacaattctaaatgaccatctgggcagctacaactgcatgctcatagctcgcatctagaggcatggttttacgctctggccctgaaggataacaaggaggcttttaaggaaatgccgtgagaaagactgctggctaagcattgtcacggccactggaggagcacctgccagtgaaccgacgctggctcccccagtctcaccagtgcacgcacactagtccgtgcaccccggccgccgctggcaggccctaccagccaagctggaggagcagctgccgcaaccacggcaagcgaactgaaatcccagagccggcctcgcccggcagagcgcccgcgcttcccgcgcagcgcacgcctcgcgcgcaaacccgagatgtgaccgcgagctgcgacctcgcgcggctgcgacgggcctcacctaacgcgcacgaggggatcatcattgctcctgccctgggcgcccgcggccctacaccacctccgcacacaacgcggccggtgttaagtctccaaacgccccgagagctccaaggaccgcgcgcgcgaaggcgccgtagcaagtgggcacacaccagacaccaccccggcgtgttccgcgggagaagccagtgcacacatcctcccgcaaggcggggttgccagtgcaacacaggaatcctgccctttttctagaaaagccccctcccccactttccctccaatacactcacctgcgtctcaacagtttccttcttgcgctacacgcggccgcacccgggcacgtccacgcccgtgcacgctgccaggcgcgactgtccccgctcggctcccgccgcccccaacctgcttgtgcccacgggaggggcggtgccacctcccgaggcgcccaattctctctactcccgccgcaacgggctgagctctaggaacttcgcgggcacaacctccgccgcccccaccagtgttcccgcccagagttcggactagggcgcaccacccctaccctgctagacgcagcgggggcgcgcacagaccttagcctcggcgtccaaaatggaccaggggcaaggcgcggacgccgtccccgcccccacgcccccagcacttgcctgctgtgactcgaagctgcagctactacggctcgtgccgctggccgtcagcactgccgcggaggagtcgctcggggcgagctccgcggagaggcggtggcggcggcggcggcgggaaaggggactggaagccggcggaacccccgccccacccgcgccgcgccgcgccgcgccggcaaccgccctcctcacccggccggctactgcctcagtgacgcccaggcgccgcggtcccgccgtt

SEQ ID NO: 1136 - DNA, 92 bp, Homo sapiens
aaggtaacaggggatacttgtaacggagagcactagcagtccatagcagtccatagcttagtgttctccattacaagtgtcccctgttcctt

SEQ ID NO: 1137 - DNA, 79 bp, Homo sapiens
ggtgcctaccttgttagcctcatgaccagccacaaagagccatatttgtgtctgatcatgagactaacaaggtaggcaa

SEQ ID NO: 1138 - DNA, 85 bp, Homo sapiens
attgacttagctgggtagtggggaacccttccatgaggagtagaacactccttatgcaagattcccttctacctggctgggttgg

SEQ ID NO: 1139 - DNA, 841 bp, Homo sapiens
ttgacttttgcaccaaaaataatttattttccaaaataaaatttaaataaataaaaataactcataatttaataaaaatttcaaaatcttctagtgtcctttcatatgcagtacattagccatcagtcacttaaacagcatctgctggttgaagaatgcttgaagcaattgtccagtcccagaggcacaggctaggagatcttcagtttcggaggtaacctgtaagtctgttaatgaagtaaaagttccttaggatttccactctgactatggtccaggcacagtgactgtactccttggccttcaggtaatgcagaatcctcccataatatcttttcaggtgcagactgctcatgagttttcccctggtgaaatcttctttctccagtttttcttccaggactgtcttcagatggtttatctgatgatagacattagccaggaggttctcaacaatagtctcattccagccagtgctagatgaatcttgtctgaaaatagcaaagatgttctggagcatctcatagatggtcaatgcggcgtcctccttctggaactgctgcagctgcttaatctcctcagggatgtcaaagttcatcctgtccttgaggcagtattcaagcctcccattcaattgccacaggagcttctgacactgaaaattgctgcttctttgtaggaatccaagcaagttgtagctcatggaaagagctgtagtggagaagcacaacaggagagcaatttggaggagacacttgttggtcatgttgacaacacgaacagtgtcgcctactacctgttgtgccagagcaaaggcttcgaaaggttgcagttagaatgt

SEQ ID NO: 1140 - DNA, 25272 bp, Homo sapiens
ccagaaactgcattagctgatgccttgatcctgagcggaattcccagcctccagaactgtgagaagcgtttgctgttgtttaagccattcggtttatggtgttctattatagcaacctgagctaagacatagggcttggaaagatatttaattttctaaacatatctaatgtttagggtgagtattattagatctgaagacagacatctgtctatgaaatatgttattctaggcaactgtggaatatattttccatccctcttctcctacagatctatttgggaacttggaagtgaaaaagaatacatgtaatttaggttatcaagtttggtttcttaatttaattgaatctattgcagctaatctcctatttctcattaaacttacaggaaaataatcagacttcatacaatgtaagtataacttgtataaaatccaaatgaagcaggaattttggtgaagcagggtatggagaatatatatgtcttaaaaatacaatgtgtgaaaaacatagcctgttatgtctagagttttgggggtatgtgcagttatttcatgtaatggatttttatcaaatacaaggtatttttccaccagaatacttcctgtgttttatttactgcactgaatccacagcctgtcttttctcgtgtcacactggaatgctgtacttcacatcttcttttttttaatgggaaagattccgaggatgtctcttctttctgagtatagatgactgtaggtaaaatacatacctaatatggagaaagaagttgcaaaagtaagtaaggttaactatttctctggaagaaacaatgcttttaaaatacagtcagagtgctgcccaaatccagggagaagacacttgcaagggagatgtgagaaggaatgtttaaagaagtgtccagattttatgcagaaagagaggtaaatcaaactcttccatcctactttttttaatgcaaggaattgtcttcctttctttagcatagctctctccaccttcctctaaagtttcacatttttgtcttttctctctatatgttgttcatatgtttgatatctgttaccttctagagataatcattattttggagatttgtgaaggttagagctgggaaaacaaaaatttaatagtgaaagttttttccccaatttcctggaaaatgattaggtttaatgatcaaatttattcaagggtaagtttttgttccatacatttctcttgagtctgtaacaccgactcccatttgcctgataggaagtgccagcttgaaaagccaaacaaacaagaaacaaaatggatataaatggaaacatcagaaatagccaattcttcttagtttgacatctaggttttatttgtagatacctgtgcacatggtcaaaacttctatatctcatacataatgcagctatattttctgatagtaaaattgttcttatttgtacagtgaaagtgaaatatatgatcccatgatgccctgcaaaaagcattataacctccaggggctttactagcaagatctagttcatgatgtcaggcttcctctttggtctctcccatgtttaccaacctgtatattaaggtagacggcaagcactaaccaaaaagtacaggaaaaatgcaaaaacaagaccaaaaaagccacttacctataaagagcatcatgagatatattttcagcacatatgggaaatagatggataagtcaaagggcagcttggtggaataagtgccaaatgattcaaaataaggcagcgattgatagatggcaaatgctgttaaaaaagaaaggcatcataaaggtattcctccttaagttgttacagggatgtgtatatatgtcttcatagttgtaggatattttgaatttgataatgacagttttgtaatagttgctgaatctttttgctaaacctagtttaatatagaaatctgtgaaatgattaagttggcaaggtgcttacagcagtatgacttgttgaatgtttgtccatggtataccttattgtgcctacagaagaatttacaatgtttcttaaaatgttatctcaaaatacatttgtccacctagccacaaataggggtgatagagagatgaacttggaaaatggtgcatatattttcctcttagagtttcacaacacacattaacatagtagaacacatattaacattgtgagaaattctgtaataaaaaaataccacctagcctttcctcaatgtaactggccttagaatatctccttcttccttcttaaccaccagtagtatttaataagtattttgaagaactctatgagaaatgctggcctaaattattttgagggagggggctggtatcaggtaaaaaaaagattaaagttcagtaacattgtatcccatgtatagatatttttggtaacatttcatgcaatgaaatgttaatatgctaacatgatgtaagatgttatcattagggtaagctgggtgaagggtacatgggaatggtgcactatttttgcaatttcttatgggtcaaaattatccctacataaaaagtttttaaaaagagaaagatgaagaaaaggcaagagttcacaactgttagagccaagcagaggtatgagtagcatcagtgaaggatctgccactgacaccaaatatgcagtttaaggttaacacaggccgcacctatgtctctagcattttatcagtataattagttgattttgttatttacataagctttgtttttgtcttatatctgtcagatgggaaattatagttattaaaattattaaaattaaagttatcgaaagtttagtaggtttatttaactgcgcagttttatactttgggacatctaacatatacagaaacacagaaagataaaattacaattatctgtattccaccatccagagcattattgacatttttgtcatatatatctctagactattttctgcatataccttattttgtaattgcaagaataagtttatgaagttaataaaagaataagggttgtatggcaaccatataagaacatggctttcctagaaaagacaaggattagaattatggaataacaagaatgcaaaagtttcctatacatttatccaccccttattcctaggaagggattagtcatatttctaccttattcctttatatattcttttaaatttgattaagttttaattggcaaatcataattgtatacatatatgaagcacaatgtgatattttgatatatgtgtacaatgtggaatgattaaatcaagctaattaacatatctaccacctcgcttacttttcgtggtgagatttgaaatgtactcttggctattttgaaatatacattattaagcacagtcaccctgctgtgcactagatctcaaaaatgtattcctcctaacaaactttgtaccctttgaccaacagctcccaatttcctttctatattctctacagtactatgatttaacaaagataatgtatttgatatttcaatgagaggttacttgattcttaaagaatggacaatcaggttcttactgttttcaagacaattattctttagatccacttggcatagtctattccaaaattaataattcttccttttgaatcaaaacaaatttagaaattctaacatgatttacagtaacaagctctttttatctgctcatcagtagatagaaaatatgtgtttttgttttataactggcttttatatactttggttattgttaatgtcgtcatcattttatgttaaacaccatgtccttatgtttttcccttagttaccttaacatgctttcttattttatgtcttcagttttgaaaactttaatcatgtcttacagaatgctccttaccagtctaccaaatccattgcagaagaaagcatatattctccaaatatcctcaagctctgctgactgatgatctgaatgatttgatcttaagttttaggtttatatttaggctatataattagcctactcatactcaataattcattctgtgttcattgagcatgtatactggtgcataaaagagaggaaggaagcaaagaaacagactcagacatcctggtaccccccccccccccagagcttacagtctagtcaaggaaatggacattaatcaaagaatcatacaaatgtgtaattatgctgatataagccctgttaagacagcagtccccaacctttttggcaccagttactggttttgtggaagacagtttttccacagaccagaggaagaaggatggtttcaggatggttcaagcacacaacatttattgtgtactttatttgtattattattacattgtaagaacaaaataattatacaactcaccataatgcagaatcagtgggagccctgagcttattttcctgcaactagatggtttcatctgggggtgatgggagacagtgaaagatcatcaggcattagattctcataaggagcacacaacctagatccctcacatgcacagttcacaacagggtttgtgctccaataagaatctgatgcctccactgatctgacaggaggtagagctcaggcgataatgtgggcaatggtgagtggctataaatacagatgaagcttcacctgctagcctactgctcacctcctggtatgcggcctggttcttaatgggccacagactgggatcatggcctagtttgggggcccctgctataaaagattcatgatactgtacccaggggaactcagttgaggaagtcagggaatgcctccctcagaaaatgatgattaatctcaaggtagagttaactagttgctgagagagggtaggatacatagtaaatggtaagtgggaaagactcaccagaggggactgaatttctgtgcattaaaagttaaaaatcatagaatctctaaatgttaacttctttttggtgaataagcagactctgagaggttaaatgagttacccaaaactcacacagtgagttaatgaagtgaaggcctcagatgccgttgctttttgtccagtattttgtctactgtgcagagctgcttccctcttcaactttgcctctttgcatcaagggaaatatgccagtaaggatacactgagtgagctaagcattcgcaaaaatagtaatttaatcatcaaaaaatttagtgaaccattataactagatggcttttgtcagtaagcaatacagcaagtcactcttttcttaccttcagcaagaacacacaaaggataaattggcatccatagtgtttgactgagccatgtcaagacagcataggatattcctatgactgataacatgctataagtgtacctgaaaggagatgagaagctcataaacatcattttctgctaatatctgggaaataggagaaactactgtgtaattaaatacagagatacaactggaaagtgtacaaattgtatattttatttcctataatttaaggaagagttttttttaaatgggggaaagggaccatgtcaatctggcttgtctcatgtggtagatcattaataattataaagctaaacagagcaagtaactcttactccctcctcagaaaaatacagttacaaatttccttgattagtgacttcaatttcattaaaaagccaagctcattttttgcagcaagcagctaggttttttaatgacagacatacttgtaaatatctcaggaattcatttaaaaataaaatgtgacttccaaatctttatttggcatccttctgcttctgcagttgtactatctatgtgatcaattaaagaactggccttgggagctgatttgggtatagtagggagctttaagcctaccactgtgatgtaaaaagtagtctacgttgtgttttatttctttgaataggacactggtttttaggcttgagcatatatcagaatcacctagatggcatgttaaaacacagattgctgggccctactccaaagtttctgatccaatggaactgtggtacaccccagactttgtattaacaagttccaggtgatgctgatgccactggtctagggaccacactttgagaactactaatatagacagacaataaatacatatggcaaaactacccaaaaaaccttgaaaacatgaatggggaagagtaaatctctctcaatccaggacctgaattccacccctcagagacaatagccaatgtcagtttcttaggtattctttcaaaaatgtttttgcatttgcatatctatgtgcatatttactatacagaatatataccagcagtggaggacctcactgaacatagcatataatcaagctttttgatctttaccaatcaaagtgaaaaatggtatctcatctttttcccctcatattagaagagtgggtaagcatgttttcatgtttaaaagccacttttggccagccgtggtggctcactcactcctgtaatcccagcactttgggaggccaagctgggcagatgacctgaggtcaggggttcaagaccagcctggccaacgtggcgaaaccccatctacactaaaaatacaaaaattagccgggcgtggtggcgggtgcctgtaatcccagctactcaggaggctgagacaggggcatcacttgaatccaggaggcggaggttgtggtgagctgagatcacaccactggactccagcctgggtgagagagcaagactccatctcaaaaaaaaaaaaaaaaagaaaagccacttttgatgaagtccaatttatcttttttttcttttgttgtgtaccttataacacagccaaatccagtcatcaagatttactcctattttttttcaaagagtttcatagttttccacttatatgtgagtggttaacttcatttttttgtgtgtgtatatccagttgtcccaacaccatttgttgaaaaagactattctttccccattgaatggtcttggcattgttgtcaaaaattaattgaccaaaaatgtgtgagagtttatctttatcaattttattccatgatttatccttacacagtaccacacttaattattgctttgtagtaagttttgaaatgggaaagattgagtccttcaactacattcttctaagattgttttggctattctgagttcctggagtttaaatatgagtgttagggtcagcttctcaatttctgcaatgaagttatctgggttctaatagggattgcactgaatctacagatcaatttggggaatattgccatctgaacaatattaagtcttccaagtcatgtgggatgtcctttcatttatttagctctttaatttttttcaacaatgctttttcaacaatgtataaattctgtgcatcttttgtcaagtttattcctaagtactttattatttttatgctactgtaaacagaattgtattcttgatttcattttatggtagttaattgcaaatatataaaaataattcatttttacatattgataattttttatgtataagatgtcatctgccaatagagatagttttacttgttgctttccagcctagatgccttttataccattttgtttgttttctgttctgccttattgccatggatagaacttccagtacgatgatgaatataactggcaagtgtggatgcccttgtcttgttcctggatattaggaggaaggcatcagtctttcatcattaactatcatgttagtatggatttttcatagatgcttttttcaggctgaggaagtctcttgctcattacttaggaaaaataatgctagggtagggtgggatgataagtttacccccattttacagaggaaaaaaaagtttctaaaagttaggtgccttggaatttcactcctaggtataagggaaatgaaaacatgtgcacacaaaagcttgtatatggatgttcatggcagtactactcatggccaaacagtagaaaccacccaaatgtccatcaactgataagtggatacacagaaagtggtaaatcaatgcaatagaattttactcagcccaaaatgcaatgaagtactgcacatgccacaacacagaggaaccttgaaaacattatgctaagtaaaagacgcctgtcacaagaggccacatattggatgactccatttatatgaactttccaggataggcaatccatagagacagcatatgtgtagtttccaggggctgagggaaagagggagaggggagtgactgctactgggtataaggtttcttttatgggtgatcaaaatgttctaggatagtagtgatgattgcacatctctttggatatactaaaactcacaaattttgtattttaaaagggtgaattttatggtatataaattatatcttaataaaactgttattaaaataagaaaggttaagtgatttgcccaacatcacttagcaagtaagtagtggaggtgggtttcatctagagagatcttctacctctatgtccaaaaatcttcctatgacagcatgctacttctttcagtgcaaatgttgttttgttctccaatgtatttattgagcttctctgacactgaaagagtaagcatagccaagagtaacatactagaaagcttcaatcccaaatgatgttccattgtctcatgaacagaagttatgggctacaaaagtccatgaagtttgccccaagtccactaaactatcaattcaaaaatgaaaaattactaatttatatacataattaaattcattttacttcagcaaaagatttcattctaattcactctaggactcaacttattatttaaacatattttaattcagttaagttattgacaatataatgaaaaaatttacatacccttggctgaaaaacaaactagggctcttttgttacctattcaaatccagatctctcaagtaggagggacggttcttatttaggaaagctgacctagcagttaggacacctccccagagtgaggcgtaagcactcactgagcaaaggggactgtttgacaccaccacttgtagaggtaagactaggcacatctcactgcaaagttttagaattagcactaaaaggacttaagttagtcatttgaacccactggaattgtaaatgaatgtgagagtgcattttcttcctgagaggccctatatttaaaagattcttgaatgcacagaaactaactgtaaattctggtgatacaataaaagacctgctttgcttattaaagcaaccgtactaaagcaattgtgaggaatgcctttgttaggaaacagctgagggttattccaagttggttttatgccaagccttctgcagaaacctgaatgtgctgatttactcttgtaataccacggtaggttttcattatctttgatatgcccattatggagaacactaaaaatacatttccatatcaagataaaataatttgaaaaggggttatgttttcctctctcgtaccaagtaacctctggttactgctagtactggtttcactgcagaaagcaatttagccttgttttaagagattattttgccttcttacctaaccatatccaatagattccaaaagacgaataaaacacacaccacatatttctcttggacttcctcttgactggtgatcaccacaaaaaggatgattattctttctgtgagctaacaaagaaacagcaaagtcagaaattaggacatctattaggctatgtaggtaattttctaattttgaaaaccagatctcctttcaaaagtatactttagctggaaatatgtatactaaactgttaacaatgcctccctctgagagagtagggttatggctgaatttcagttcctcatttgtctatattttacaaataatatataatgaatgaaaaaatgacatatattttatgtgaatcaggatatttcctttcttcttgccacatgcatgtgtttctagtcactttgacaaggctttattgagtgtccactgtgtgtcagatgccaaaatgaaaacacagtctttgctccaaagagggtagcagtggtgggagaactgaacaatagccagcacagtgtgtgccagatatgggagcacaggtgagcgagatactttctgcctggagaaagaatgcaaagagattaatgaagacatgctacatttcatttcatccaagttggatcttgaaaaatgaataagagtttgtcaggtagactgggtataacagaaggcatcctaggcaaagggagcagcctgagcaaagaggcagaggtatgaaaatgtagggtgcccaggggagtaatgtgaaccactggggggctagaggggagggtgcatagaagggaataaaaggagatgaaattgaaaacatgtttggaggtgggttgtgaagggttttgaaagacaggctgagaaatttcagttccatccaatagagaaacttgtagcttttttttttcttttttttggtaggggagtaatataatcctaacccttataagctagcagaaaatgaaaagaattcaatatattccaagtcagcatttacaaatcattgagacttcacacatttttggcttagccccaattactagcctcaaaaaataaaaaaatacattcctttttcccaacctaaatataaagtgccttcttatgttatattaatatatcctgtacattctgtattttgtgtgtttttaataaaatgttttacttgctcttaatggtcaaaggaaaatatacttaagattgaacagtcaaattcacagtaaagaggggaatgatttatatttttctttattttaaaagtggatcaaggagaaaagactgggataacctgtgacttggcatttataggctgctagtcctggaaaatcacctagtgcccagaaatccaagatttgccaacagtgggccacatgatcagaaatccacgtgtataagctatatcagcatgtttacgacatgactacagtggtgagtcaagagggtctatgtttggctaaggggaattatatatgattcaaaccttagtcaaaccatggaagctatctacatagctgtttttcttttttcagtctttctttataatataatactctattgatttaatttcaataataaattctactgaactgcaattataattactgaacaatccaaccttgatgtcatgacacctctcagccttcagatacacgatcatagcaacaaataagttcttaggctctacctctcttacatttgatcagtgcttggttattaggaaaaccttctggtttttgctagaaatctcaggagatacacatacatgaatggatacatgaataaaatacagatttctaattacatggctggctactcaaaaaacttagacacctttcaataagatgatctctagggtctcctccagataaaacattctgatactagcccagccccacctttttggaaacaaggaatttgggaacagacctggaaacatatatatatccgaagtctcctggtttccagagttgtaagctatccatgatgtcaggtcatcccttaattgaagaggacagaggggaaaatctcctaaaagggagagactggagctgcatgatgaaactcaccctgttgaaaatcatcacttcactgtctgtggcaaggtagcgatgaaatcccagctgcacagaaagcagcaacaggatggacccccaaaccaaaccacaacacacatacacacgagtgaagactccctctatattcggtgtcaatctaattcgttaacaaatcatctgatggttattcaactctaacttgaccattcaatggcaatacaatggggaaatttaggcagagatgttcttaaattgaaataaagctaatatttattgtttaccttgtgccaggttccaaatatacaccatctcattttatctccataatgaccctaagaagtaggtgctattattgttctaggcgttttacaaaagacatgcattttaccaactgaaagtgacttacctacaagtctggaatcaacatctagacaatacgacttcaaattcctgaaatactaagactctttcaccattgttacttgatatgagttactccatcacctagtatccagattatagcctattctttaaaaaagcttctccttaaaaattaagccttaaaacaagagcctccttgattttcttaacaccaaaacaattttgaagaaaaggcttttaatatttatcagtcttctctaatatgaccatttgaccagttatttagagcttgacacatggaagaatttagccctttgtcatttttaacaaaccctgtgaaaatatgacaaattactagagaatggtcttgtttagtacaactcaaacaggtagagtaaaaggtatagtaaatatcctacaacttgggttacattaaacatagtgataatgtcatctactcaaaagtgtgataactatataataaaaatgctgggcatttttatgttctatttgggaatcctaaactccaggttgagcaaaaattgaaactaagttgttactttacaaatggcaggtagcacttgatttataagctatgggagggtaaaaatgatacttcaactacaggaaaaattaatttctagaatcttaaaattagttttagtctaaaagactactattttactaaaatgaaaatctaaactctcaatcctctgaacttttctgagaacttcagaaatctatatattcaaaaactaccaattacatgcttctataagacaaatgcatttaaataattgtatttgcttccttctttattcatcattcaatagataattattgagtgcactgttctgggtcccaagggatatagctgtgaacaagaccaagcccctgccttcatgatatttatattacacttggtgaaacactaaacaaatgtagcataatagttgagagctcaagagccaaagagcttaaatgtctgctacaatattcaaaacctatgtgaccttgcataatttacttctgtgttaagtaattataccagagataataattagcatctattgttacatagtaattattatatacaggaaaaggttgttgtaaagattaaataagttaatacatgtaaagaactgagaaaagtgtttgacacacataaaagcccaaataaatgtaagctatgattaggaaaataagtatttaaatatactttaatgtagtgatttacattgtatttacaggaaaacatttttctatgtagataatgactgtgaattaaaaaattcaatctcaacatctgtaaaattacactagaaatatagctttatacttatcacacatggatcaaatgtgaaaaacaggaagattctaaaatcttacctacagagtgaattggacatgtaattcaccctcaggaggcttcaaaatttggagaatgttacaactcaacactgtcttttatagtttcttctctaacaatataagcctattccaagctcaaaactggtgagaaaaatctatgtgattttaatggaaagtcagattatttagtctagcaatgcaaataagcacctgcttcatggctaaaaataaattagggtaaaatctggctttttgcctaaaaggcaaaaaggaattcctttgggaattccttcatatttgttctcttaagagtatgtgactgtgaaatctttagagggatttttgacaaacagatccctgcttgccctgatcagaaatagaagtgttactggcaaatacagaaacagtttatgtgatttgggctcataaatggaatctccgtaagcacaatcatttaggagtattagtttttagtgttttggttgagaaattttaaaaattgagtaaaaatgtgtaaaattaatagtgcaggagtgtttattatgacacagagggaaggatgtataattgaatcattttaattcaattacaaatgaaatattggcatttaaagcatttctcaaaaagtgatggagtaatctattaagggtttcctataggggatatcagtctaatgttatgacacaaaggttagtgttggctattttcccctcttcttgagttgaaacatcctaaagcagcatgaataaaaatctcctcctcaggcttctgtacaagcaaactgaacaaagccccttaaaatcaacatttcaggcttgatagtgtttctgtactataaaagtcaagttgttttgattaaatttactgaaatcaactagttttccaattcaacatttttttctaagctaataaagtttgcaagctcatttcggaggaggggattggagaggagaaatacctagttttgatttatattatcatttcttttatgcttcttttggaccattttaacttttccattttgaaaagtaaaagtatcaaagtttactatattttcttatatgatttttattgtcgtgtaattatttcaaaaattggaagtccataaatagctacgctatggttttgcccttttccccaaagcgtataaaaaaataaaatatatgtcagtcaaatgattattgtcttttagtcaatgggttttttcctttcctttcatatgtaattttagaaattcataatggtttctccctaggtatcaaaataaagatgtgcatgtaaaacatttaaaaatgcacagggcaaaccgagtccagcagcacatcaaaaagcttatccaccacgatcaagttggcttcatccctgggatgcaaggctggttcaacatactcagatcaataaacgtaatccatcatataaacagaaccaaagacaaaaaccacatgattatctcaatagatgcagaaaaggcctttgacaaaattcagcagcccttcatgctaaaaaatctccataagctaggtattgatgggacgtatctcaaaataataagagctatttatgacaaaccgacagccaatatcatactgaattggcaaaaactggaagcattccctatgaaaactggcacaagacagggatgccctctctcaccactcctattcaacataatgttggaagttctggccagggcaatcaggcaggagaaggaaataaagggtattcaattaggaaaagaggaagtcaaattgtctctgtctgcagatgacatgattgtatatttagaaaaccccatcgtctcagcccaaaatctccttaagctgataagcaacttcagcaaagtctcaggatacagaatcaatgcgcaaaactcacaagcattcctatataccaataacagacaaacagagagccaaatcatgagtgaactcccattcacaattgcttcaaagagaataaaatacctaggaatccaacttaaaagggatgtgaaggacctcttcaaggagaactacaaaccactgctcaacgaaataaaagaggacacaaacaaatggaagaacattccatgctcatgggtaggaagaatcaatatcgtgaaaatggccatactgcccaaggtaatttatagattcaatgccatccccatcaagctaccaatgactttcttcacggaactggaaaaaactactttaaagttcatatggaaccaaaaaagagcccgcatcaccaagacaatcctaagccaaaagaacaaagctagaggcatcacgctacctgacttcaaactatactacaaggctacagtaaccaaaacagcatggtactggtaccaaaacagagatatagaccaatggaacagaagagagccctcagaagtaataccacacatctacaaccatctgatctttgacaaacctgacaaaaacaacaaatggggaaaggattccctatttaataaatggtgctaggaaaactggctagccatatgtagctgaaactgaatcccttccttaaaccttatacaaaaattaattcacgatgtattaaagactgaaacgtttgacctaaaaccataaaaaccctagaagaacacctaggcaataccactcaggacataggcatgggcaaggacttcatgactaaaacaccaaaagcaatggcaacaaaagccaaaattgacaaatgggatctaattaaactaaaaagctccggtacagcaaaagaaactaccatcagagtgaacaggcaacctacagaatgggagaaaatttttacaatctacccatctgacaaagggttaatatccagaatctacaaagaacaaatttacaggaaaaaaaatcaaccccatcaaaaagtgggcaaaggatatgaacagatacttctcaaaagaacacatttatgcagccaacagacacatgaaaaaatgctcatcatcactggccatagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcaaggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccatcaatgatagactggattaagaaaatgtggcacatatacaccaccgaatactatgcagccataaaaaatgatgagttcatgtcctttgtagggacatggatgaagctggaaaccatcattctgagcaaactatcgcaaggacagaaaaacaaacaccacatgttctccctcacaggtgggaactgaacaatgagaacacttggacacaggaaggggaatatcacacacaggggcctgttgtggggtggggggaggggggaggaatagcattaggagatatacctaatataaatgacgagttaatgggtgcagcacaccaacatggcacatgtatacatatgtaacaaacctgcacactgtacacaggtaccctagaacttaaagtataatttaaaaaattaaaaaataaatgcacaagaaacagaaacacagcacaaaaacaaacctatcccctgtggacacaccaccactacttgatatgtgtaatgccaattgctcaactagctaatcagttcctactgttggttggaattatttctcttgatattgtggaggaccagttccccccaagaagaattcagttgtcacttaacaatcttttttttttttttttttgagacggagtcttgctccgtcacccaggctggagtgcagtggcctgatctctgctcactgtaatctctgcctccagggttcaagtgattctcctgcctcagcctcccgagtagctgggatcacaggcacgcgccaccacgtccagctaatttttttgtatttttagtagagacagggtttcaccatgttggccaggatggtctcgatctcttgacctcgtgatccgaccgcctcagcctcccaaagtgctgggattacaggcgtgagccactgcacctggcccacttaactatctcttgaaggtaataatcaaaatcacatcacaactgtatcgacatggttttttagcttacttaaaagcagccactctcttaactacagtttcttcatttaaaaatggggaaacaggaaaaccaagaatgattacacaatctgaaagttttgtttcattattttaaagcaggggcctcagcgccatcccataatgagggaattctaattgtctgcataattctaatataggaaggagggagaaaatgaaactttgggcacaaaggcatgtttctgaacctttatccaacaccatttccattgtgggaaccacaaaaaggatgataaattaataaaagaaataggggccaaataaaatcttaaaagagataaaaagaggaagccaaacaaccacaacaaaaattgataatattcagctcaggaagagaataattttcttccctaacacagtgatctctgacttatctctcccagtaactgaagacttaaaaatcatttgcactccgataacatcagattttgcaaactcgcctttgaataaaaggtctcaatgtatatttgcccctatgtttaaattgccaaaccaagatttggttctttgattacagttatatttctataagccattaaagttttaattagcagtgattaaaatcaggtgtatattctggaattcctccaagaaatcagatttctaagttatataataatttctattactaaacaagcctaattttgtaaagcacatatgtgcacattttctaggcacattcaaggtgctcagtgagttttcttccttaaaaaattatctattccctgtaggtgcattctctacactggcaataattaaataacactacttttgattttgaaaatgtttaccatgaaactagtagcagccacttagcctaaaaaagtaaaaaggcctttaaaaaataccaatagaaaacataactgagattttaaatgaatttagtcatactccaagcaaaatcattccagatgatagaacacaacttttatttaacgttagttgttaattctattttccaacattaacattatgggatgctggtactacatgtattttggttgtttcaaagtacaccacattgtaaataagtaataaacaccaataaatcttgctcccagatactatgttgctgttgggacagatctgtatccccgtttattttgtaaggaactatactaaagggaattccatctaggtcttagctagttaagtgactactatgttattagtttatacaccattaccctaacttttattttatatttgatatttcaacattttaaatgtctttatcctaatggatactatttccctactgttacttaataagcaaaatttaaaatattccataaacttgtaatgctcagttcttaaaaggctccttaggattatactatttatatcttttaagcttttatgatattttagacaaattttaatataaggatctataccactctttcatttaacaaaaatttaaagtgtacatttacattctaagcactttgctaggtgctggcaacaccataaaattctgacattttcattatttttacaatgtgaaattgtcaaaattatcaatttttcaaatttattttgaggatacctaaaattatactcatgtagatacctatttctgtagacttgaaactcgtgttcttatagttgcctaacctttactgtcccataagaaagggacaactatatgagctatataaaatttacagaaaatctttatttttatttttttgcctttatccagcaatgattttctacatgaagtcactactagtaaatttcccatcttccttcaacctgtctttacaaagaacatggtaatctagggctagaggcatggaagagggaacaaagaatagttaagaaaatagtaataatagctgccgagtattgtattcttaactaagtgccaggaacttatccattttctcagttacttcataagatacatgttattttcatatcacatgagaaaatgcagttcagaatgattaaatgacttgtttaaatgtatacaactagtgcaaagtagaactgggatttgaatccgggtctgtgtgttccccaagtctatccttagatgctgtactagataaacacaaatgatctcctctttccattgacgtttagtaaaaaagagggaatgagcaagaaatggcctaggagtactctattctctggatgtagatgaaggaagccttttgttttttaatcatctactctttgccaggtattatttgtggtgtcctttccctcaacagcccaatggttgttcccatagtatgggtggtatgatcccatagtggtaagcagaaaagccaggcttcaagcctaagtctccagtcctatgccttatcattgtcttctactaacccaggcagtgacacagtgagggtagcaagtggctacgaaatctccttccaggataggaccaatgcagtgctgcaagatcagcaagcatcactgccctcagtgtttccaactggttattctaactgggcagttttacaataaggttgtccttccatgaaattaattctccttatcagtgacctaagacaagggttggctttctaactgccataaagtcaagagaagctttaaagagaaaaaatgtaaaaatgaaacagattctataataatatgtgattcaaacctacctgcaaaaaccttgggagaagatggtttgactcaatgccaacatatatgtgcagcagttccaggagagatacggattggcaaagtcgcatcacaagtccaatagcataaaaagtgtcaaccattgaatctgtatcccgtgggttaaaaatgcagatataggaagaaaaaactggattataacccaaatttatgcagcactttgaagtcaaatggagattattcacttcctttttcattgtacatgtgaaaaattccttaagtaggctactaaattattaacaatacaatgcaaacaaacaaagcacttcatactgtagtctattttaattgctcctgttccaaaaagaaatcgaaacttgagaaagatttcatggccaaacatacacatagcatttattccccacttataagattataaagcaattcccacataagagtaacctcctagaatctagaccacctcaagtgtaaatagaagtgagcttgttaaggacactatgtgctcacagcttctccactgacaagaaaatgacaaagatgagaaaaaatattatttcggagaaactttatggaaatgacactaataatgccatgatatcaaataacataggtatctaggattttgtttctatacatatttggttagtgcttttctggattttgttaaacactggaacttgggcctctgatcaggacttttggggtttgcattgcagagggttcacatgaaatactgtgcacttggagctgaaatggaagggaaacaaatgttcctctacataggataaatgtgttgctttaagttctaaaatgaaatcctgccatgtttagaaactcgtagggaagattttgctctctttactgcccagtgatgattcacacaataataatttactgagcagtaaggatttctcttctcggcagctccacaagatggacactattatcatcatccccatttcagagatggttcctgaagtacacagtccatgctcttatccactgccctgcacttgctgtaccagagcattatgaattacacagctccgtgaaggaagaaggtagcaggtataacacgttcagggtttcaggtttctgttgagctacttacataatttatacattgattcaaaaattgtactgaaaccacacttagttgttttcagtctgtctcctgaacgaatcggttgtgtttctttaataataagcttctacaattgtaatggcaggataataactgagaaagaaatgcgccgagccgggcacagtggctcacgcctgtaatcccagcactttgggaggctgaggcaggcggatcacctttggtcaggagttcaataccagcctggccaatgtggtgaaaccccgtgtctactgaaaatacaaaaattagccaggcatggtggcgggcacctgtaatcccagctactcagggaactgaggcaggagaatcacttgaacctgggagacagaggttgcagtgaggtgacatcgtaccattgcactccagcctgggcgacaagagggaaactccatctcaaaaaaaaaaaaaaaagaaaaaagaaaagaaaaaaaaagaaagaaaagaaaaagaaatacttgatgactaaggcaacttttctcactggaaaggtgagacagcataagccagtccatggcttgtgttgccaatgacatgtaatatgcctgcactgcctcagcaaacctcaaagggctagaagtgatggctttttaataaaaatataaaagaagttttcccatcacctgtgttttcctgtgcttgaaaactctcaacatttgtagttgaaactcaagctttaggttatatctttggaggtccttaacaaaggcgagactatatctgtagattttcagtaagaaaaagcaacataaaatagcttatgggaccctgcaagtagaataacttccttatgatacacacgtctgaaatgatgagcacagcatgacttttcccagctacattctaaacatttgtttttagctgaagccagcagttgcttagattgtcaagtcactcaacagttgtaaactgtgaggacacttacccacgtgcggatggaacatgaagagaatgttattttgatagtcatttagtcacccaacagtgactttacttttcaggaaactagaggaagtttatgacttaaaccattaatgctgactcctatataagtggttagccctctacaaagtgtgtcatttacatattacttcttaaagggaccaaatagaggcttggggaatataaaatttgtatttcacttactagtagtctccagttacctcaaacctggggaataatacaaacactggaagaatttgattcattcctgatttctctgcataaaatgttatgctgagatttcctcaaaacactagaaatctgctaaggtttggtacagaatggaaaaggaacaatgaaatgataccacctcagtgccatccatctcttttttgaggcaaactgccaactcagggggaagccaaatccctttcccttacttatcccaccttcccccttccccaagaaggttttgcaataaacatggttgctaaaaaatacaaattttagagaaggatattagaaggttgaggtgtgtagaaatttaatataagcaggatgaggtgaaaacaaggattaaaagttaaaaataaaaaaactgtttcggagttttaccttttccaaatgaaaagaatctgactgtcatatttgtaaatatccaagagtggccacagaactggattaagtaatagatgaaaagatacgcattcttcctatacctataaatacaggaaaataccattaaacacttcttttataatcatcctttcatcactgtacacatgccctttaatgtactggccaacctgagaaagcaaaagaaaactgtttcatatcagtcttttatctggttacccccaagtacatatcagattttgaagggagccataacctacactacccgctaaagtaaatacagatgcttcttcacttatgatgaagttacgtcctggtacaccccatcagctgaaaatatcataaactgaaaatatcataagttgaaaatgcatgtaatacaactgatctacagaacatcacagcttagcctagtctaccttaaacttgctcagaacacctacattagcttacagttgggtggaatcatctggcaacacagtgcactgtggagtaccggttgtttaccttcctgatcatgcggccgactgggagctgcggcctgatgccgcggcccagcatcatgaaaggatatcatacctgcacatcgctagcctggggaaagattaaaatccaaaatttgaagtacggtttctaatgaatacatatcattttcacaccatcacaaagtttaaaaaattgtgagtcatggaccatctgtatagtgagtttgcttaaaaccaaatatagtgctttttcaaaatctgctttcatctttgataaagttctaaccttgctgctcaccaaggaataaaagaaaccactgcgaaggtggctttgaatattctttaaaaaaacaaaacaggctgggcgcggtggctcaggcatgtaatcccagcactttgggaggccaaggcgggttggatcacttgaggccagaagttcaagaccagcctggccaacatggcaacttacaaaaaaaaaaaaaaaaaagccggatgtggtaacgtatgcctgtaatcccagctacctagctgctcaggaggctgaggcaggacaatcacttgaacctgggaggtagaggctgcagtgaaccgagacagcgccactgcactccagcctgggcgacagatcaaaactctgttctcaaaaataaataaaaaataaaaaacaaaacaacaacaacaacaaaaaatccatgtgtgcagagtggttgacatgtcactatgtgttccagtagctcagcttgctaagtgcagaacttgagacacagtgttttagttctgaaggggggtagggatgggagtaatccaaatgttgggtaattcagtaattggacacacctgacttttgaacacattatgtgattgaggttagtattaacatcttgccactgcctattaacattttgcaagggtagatagtttccttcatcagatacatatcgaaagcagtttagttgctcataccagaagagggaagtcaagctgggtttaacaatgtgttgtgagttgctggggagatgactaagagaagattgacagatagatggtttgagggagttaggaaaagcactgtttgaaatgttccctgggagttcagaagagtgacgggagtggccctgccagtgtggtcaagatttactcctccttgaagatgtgaaacctcctagaaacaaggaaaataagctgggaggcagaatgatttttatttggggacatcctcccctataaaggcaggaactgctaaagggtttgggaagaggaaatcctccttcagcttgtatcagaattacctggcttgtgggttaaacatatacacccccaggccctaccgctatatgactgaatctgttccccgccggaactaggccctgaaatctatacgtgtgataggtgtttccacggctgttacatctaaaaatcaccccgcaactctgcgtctgagaaagtcaagagaaggctcctggggggagggaagtactggcagagggctcacaagggcaggggtagccatgcagcctgtccttcccattcaactgtaaaatggagaaaataacagagcctgcttcctagggtggtcaagaggggtaagttagcaaatacctgcatgagctccaaggggtgcctgggcacggtagcgctgcgccttgctggcgggcggggggtgccgcccgcccgcccgccgcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtacc

SEQ ID NO: 1141 - DNA, 738 bp, Homo sapiens
tgaaaacatttggaaattttgattcaacttgtggtggttatagaagtgagtctttgaaatggaagaactcatgaaagtgtgagatgatgcattagtcaatgagaatcatttccatgatgaaccagttttcaatccttcctccttaatccttttttcaagtttgttgaaaaagagaaggatctcatgatttctgctctgacaacctcccaggcacaagggctgtatttcttctccattagataaagagtgattctttggaagtatttcctcacagccaggatgaagtcctcattcatcaggggagtctcttccaccccaacctcctgtatcacacatgcttccaggtcattcagttgctggtaaagttcagtggaaaatttttctaggaggctctgttcccaagcagcagatgagtcctctgtgctgaagagattgaaggtctgctggatcatctcatggaggacagagatggcttgagtcttctggaactggtggccatcaaactcctcctctgggaatctgaattcatgtctgtccttcaagcaggagaaaggagagattcttcccatttgtgccaggagtatcaaggccctcctattacgcaggctgtgggtctgaggcagatcacagcccagagagcagatggatttgtagctgagtaccagcacgaccatcagtaaagaaaaggaccgggccattgggattttgcaaatatcactaggctacctgaggtgggta

SEQ ID NO: 1142 - DNA, 940 bp, Homo sapiens
tgtatagtaaaaatttaatgaaaaggaagttaatatattaactaaatatgaagaacatatattgttacattaagcaaaatgtaaaggtacacatgatattacataaaacatgatttaaaccttaaaaatagttaaataaataaatatttaaataaatagatgaatagagacatcagcatggtcatctgtaaaggactagtgcctgcacaggtaaacacgatgcttctttacactcctgaaaacatttgaaaattttgattcaacttgtggtggttatagaagtgagtctttgaaatggaagaactcatgaaagtgtgagatgatgtattaatcaatgaggatcatttccatgttgaatgagttttcaatccttccttcttaatcctttttgcaagtttgttgaaaaagagaaggatctcatgatttctgctctgacaacctcccaggcacaagggctgtatttcttccccatcagataaagagtgattctttgaaagtatttcctcacagccaggatggagtcctcattcatcagggcaatctcttccaccccaacctcctgtgtcacacaggcttctaggtcattcagttgctggaaaagttcaatgtagaatttgtctaggagggtctcatcccaagcagcagatgaatcctttgtgctgaagagattgaaggtctgctggatcatctcatggaaggcagagatggcttgagccttctggaactggttgccatcaaacacctcctgggggaatccgaaatcatatctgtccttcaggcaggagaaatgagagattcttcccatttgtgccaggagtatcaaggccctcctattacccaggctgtgagtctgaggcagatcacagcccagagaacagatggatttgtagctgagcaccagcacggccatcagtaaagaaaaggacagggccattgggat

SEQ ID NO: 1143 - DNA, 779 bp, Homo sapiens
ctgcacaggtatacatgatgcttctttacactcctgaaaacatttgaaaattttgattcaacttgtggtggttataggagaagtgagtctttgaaatggaagaactcatgaaagtgtgagatgatgtattagtcaatgagaatcatttccatgatgaaccagttttcaatccttcctccttaatcttttttgcaagtttgttgaaaaagagagggatctcatgatttctgctctgacaacctcccaggcacaagggctgtatttcttctccatcagataaagagtgattctttggaagtatttcttcacagccaggatggagtcctcattcatcaggggagtctcttccaccccaacctcctgtatcacacaggcttccaggtcattcatttgctggaaaagttcaatgtagaatttttctaggagggtctcatcccaagcagcagatgagttctttgtgctgaagagattgaaggtctgctgcatcatctcatggaggacagagatggcttgagctttctggaactggttgccatcaaattcctcctggggaaattcaaagtcatgtctgtccttcaggcaggagaaaggagagattctcctcatttgtgccatgagcatcaaagtcctcctgttattcaggctgtgggtttgagacagattacagcccagagagcagcttgacttgcagctgagcaccaccagggccatcattaaagcaaagggcaatgccattgggaatcccgaagatgctgctgggctggttgatgaggggtaac

SEQ ID NO: 1144 - DNA, 1025 bp, Homo sapiens
tgggcttggtatttctttattaaagaataaacaaataatataagaagttttaatagtaaaaattaataaaaagaaaataatatattgactaaatataaataacatattttgatataacacaatgtaaaagtacacataatattacatggacaaaaataatttaaatctaataaataaataaatatttcaatagatagataattagatctatcagcatggtcatctgtaaaggactagtgcctgcacaggtaaacatgatgtttccttacactcctgaaaagatctgaaaattttgattcaactcatgcggtggttataggagaaatgagtctttgaaatggcagaagtcatagaagtgtggactggtgtattagtcaatacagatcatttccatgttgaaacaggtttcattccttcctccttaatctttcttgaaaaatttttgataaagagaaggatctcatgatttctgctctgacaacctcccaggcacaagggctgtatttcttctctgtcagataaagagtgattctttggaagtatttcttcacagccaggatggagtccacattcatcaggggagtctcttccaccccaacctcctgtatcacgcaggcttccaggtcattcagctgctggttaagttcagtggaaaatttttctaggaggctctgttcccaagtagcagatgagtcctttgtgctgaagagattgaaggtctgctggatcatctcatggaggacagagatggcttgagccttctggaactggttgccatcaaactcctcctgggggaatccaaagtcatgtctgtccttcaggcaggagaaaggagagattcttcccatttgtgccaggagtatcaaggccctcctattacccaggctgtgggtctgaggcagatcacagcccagagaacagatggatttgtagctgagcaccagcacggccatcagtaaagaaaaggacagggccattgggatgttgccaatattgctaggctacttgagatgggtaaccttgaa

SEQ ID NO: 1145 - DNA, 964 bp, Homo sapiens
tgtatagtaaaaatttaatgaaaaaggaaattaatatattggctaaatatgaagaacatatattgttacattaaccacaatgtaaagcgactcatgatattacataaattttaaaaataattaaataaatatttaaacaaaagatgaacagagacatcagaatggtcatctgtaaaggactagtgcctgcacaggtatacacgacacttctttacactgctgaaaacatttgaaaattttgattcaacgcgtcgtggttatagaagtgagtctttgaaatggaagaactcatgaaagtgtgagataatgtattagtcaatcaggatcattgccatgttgaaccagttttcaatccttcctccttaatcttttttgcaagtttgttgaaaacgagagggatctcatgatttctgctctgacaacctcccaggcacaagggctgtatttcctctctattagataaagagtgattctttggaagtatttcctcacagccaggatggagtcctcattcatcaggggagtctcttccaccccaacctcctgtatcacacatgcttccaggtcattcagttgctggtaaagttcagtggaaaatttttctaggaggctctgttcccaagcagcagatgagtcctctgtgctgaagagattgaaggtctgctggatcatctcatggaggacagagatggcttgagccttctggaactggttgccatcaaactcctcctgggggattcggaaatcatgtctgtccttcaggcaggagaaaggagagattcttcccatttgtcccaggagtatcaaggccctcctattacccaggctgtgggtctgaggcagatcacagcctagagaacagatggatttgtagctgagcaccagcacggccataagtaaagaaaaggacagggccattgggatgttgcaaatattgctaggctacttgagatggataaccttg

SEQ ID NO: 1146 - DNA, 1515 bp, Homo sapiens
tgtttgaaaataatttaataaataacaaaatacaatatttaaccaaatggaaagctgaacatgttttgttatcttaatacaatgtaaaggcaaacatttgttatataagaatataaatagtataaatatgataaaatgtaagaataaataaatgagtaaaaataaataacatcttagggactgatgcccctgaacctaagtctttttaacatatactggcttaatataccgacaaagtatttgcagaactaattcagtcaattctgtgattaaagccgaaataagagtcttttgaattgaccagagtcacatgtgcaagtgttatatggcaaattaatcaatgagaatcatttcaagatgagcccaggtctctatctttacttctcagtctttcttgcatgtttgttgataagaacaaggatttcatgatttccattctgacaacttcccaggcacagtcgctgtatttcttctctttcaggtagacacggattccctggaagtacctcctcaaggtcagtgcagggctgctaattgccccagcagattctccttctcccactacctgcagcaagcaggtctccaggtgttgcagttgctgatgaagtccagtgtggagttggtctaggagggtcatgttccaggcagcagaggagcgctctgtgtggaagaggctgaagatctgctgcagcatctcatggaggacagacatgacatgggccttctgcaactggctcccttttaccatctcctgggggaacctgaagtctcttctgtccttgagacacaagaaaggggagattctcctcatttggtgcagaagcaccaaggtgttcctgctaagtaggccatggttctgaggcagatcacagcccagagatccaacagggctatagctggtcatcactagggctgccagtagagggaacaggagggccattgggaaatgaggatgctcctggctttactgagctgggatatggcttaaccttggaccctaggttttctgaagacattgcttgtatgcatggcttttaataggaaacacatggttttcattttctgaacatttctctgtactttcagtttcttttactgttttcatttgtgtgttctccctatgaccttaagaggatgacaacaatctattaattttgcattagacttcagctaaactccagtaaacttcagctgtgtcaatacaaatgaatgcttaatcaaatgaaaaacgtctgggtactaaagtcataagtgtatatactatatgcatgtaaataatcagacacacactacactaacaatatatatattatatatttatgtatacacactatagtgaatatatgtatatatgtgtatatataatatatattcatatatatatgaaaaaaatcattttctctgttctagaagcaaaattttaacccttattctagcctccatttttaccctccttactttatgtaggaagtcaggccctataggtttctatatttgcttcaggtttaccagatc

SEQ ID NO: 1147 - DNA, 982 bp, Homo sapiens
tttaatgaaaaaggaaattaatatattggctaaatatgaagaacatatattgttacattcaccacaatgtaaaggtactcatgatatcacataaaaaataatttaaattttaaaaataaataaatatttaaataaatagatgaacagagacatcagcattgtcatctgtaaaggactagtgcctgcacaggtatacaccaagcttcttcacactgctgaaaacatttgaaaattttgattcaactcgtggtggttatagaagtgagtctttgaaatggaagaactcatgaaagtgtgagataatgtattagtcaatcaggatcatttccatgttgaaccaggtttcaatccttcctccttaatcttttttgcaagtttgttgaaaacgagagggatctcatgatttctgctctgacaacctcccaggcacaagggctgtatttcttctctgttagataaagagtgattctttggaagtatttcctcacagccaggatggagtcctcattcatcaggggagtctcttccaccccaacctcctgtatcacacatgcttccaggtcattcagttgctggtaaagttcagtggaaaatttttctaggaggctctgttcccaagcagcagatgagtcctctgtgctgaagagattgaaggtctgctggatcatctcatggaggacagagatggcttgagccttctggaactggtggccatcaaactcctcctcggggaatccgaaatcatgtctgtccttcaggcaggagaaatgagagattcttcccatttgtgccaggagtatcaaggccctcctattacccaggctgtgggtctgaggcagatcacagcccagagaacagatggatttgtagctgagcaccagcacggccatcagtaaagaaaaggacagggccattgggatgttgcaaatattgctaggctacttgagatggataaccttgaacttcggcctctaggttttct

SEQ ID NO: 1148 - DNA, 981 bp, Homo sapiens
tgtatagtaaaaatttaatgaaaaaggaaattaatatattggctaaatatgaagaacatatattgttacattcaccacaatgtaaaggtacacatgatattacataaaaaaataatttaaatcttaaaaataattaaataaatatttaaataaatagatgaacagagacatcagcatggtcatctgtaaagtactagtgcctgcacaggtatacacgacgcttctttacactgctgaaaacatttgaaaattttgattcaactcgtggtggttatagaagtgagtctttgaaatggaggaactcatgaaagtgtgagataatgtattagtcaatcaggatcattgccatgttgaaccagttttcaatccttcctccttaatattttttgcaagtttgttgaaaaagagagagatctcatgatttctgctctgacaacctcccaggcacaagggctgtatttcttctctgttagataaagagtgattctttggaagtatttcctcacagccaggatggagtcctcattcatcaggggagtctcttccatcccaacctcctgtatcacacatgcttccaggttattcagttgctggtaaagttcagtggaaaatttttctaggaggctctgttcccaagcagcagatgagtcctctgtgctgaagagattgaaggtctgctggatcatctcatggaggacagagatggcttgagtcttctggaactggttgccatcaaactcctcctggggaagtccaaagtcatgtctgtccttcaggcaggagaaaggagagattcttcccatttgtgccaggagtatcaaggccctcctattacccaggctgtgggtctgaggcagatcacagcctagagaacagatggatttgtagctgagcaccagcacggccatcagtaaagaaaaggacagggccattgggatgttgcaaatgttgctaggctacttgagatgggtaaccttgaac

SEQ ID NO: 1149 - DNA, 571 bp, Homo sapiens
cttattccttcctccttaacctttcttgcaagtttcttgatgaagagaaggatctcatgatttctgctctgacaacctcccaggcacaagggctgtactttttctctgtcaggtagagagtgattctttggaagtattttctcacagccaggatggagtcctcattcatcaggggagtccctcccacccacacctcctgcatcacacaggcttccaggtcattcagctgctggtaaagttcagtatagagtttgtctagaagcctctcatcccaagcaacagatgagtcctttgtgctgaagaggttgaaggtctgctgaatcacctcatggaggacagagatggcttcagccttctggaactggttgccatcaaactcctcctggggaaatctgaagtcatgtctgtccttcagacaggagaaaagagagattctcctcatttgtgccaggagcatcatggtcctcctgtgacccaggctgtgggtctgaggcagatcacagtccagagagcagcttgacttgcagctgagcaccaccagggccatcagtaaagcaaaaggcaaagccat

SEQ ID NO: 1150 - DNA, 701 bp, Homo sapiens
ttgaaacggcagaactcaagaagtgtgaaatggtgtactagtcaatgagaatcatttcgatgttgaaccagttttcattccttcctccttaatctttcttgcaagtttgctgataaagagaaggatctcatgatttctgctctgacaacctcccatgcacaagggctgtatttcttctctgtcagatagagggtgattctttgaaagtattttctcacagtcaggatagagtccacattcatcagaggagtgtcttccactccaacctcctgcatcatacaggcttccaggtcattcagctgctggtaaagttcagtgtagaatttgtctagaagtgtctcatcccaagtagcagatgagtcctttgtgctgaagagattgaaggtctgctggatcatctcatggaggacagagatggcttgagccttctggaactggttgccatcaaactcctcctgaggaaatccaaagtcatgtctgtccttcaggcaggagaaaggagagattcttcccatttgtgccattatcatcaaagtcctcctgttactcaggctgtgggtctgaggcagatcacagcccagagaacagattgacttgcagttgagcaccaccagggccatcagtaaaacaaagggcaaggccattggggaggttgcagatgcttctgggctgttgagattgagtgaccctgaaccttgggc

SEQ ID NO: 1151 - DNA, 706 bp, Homo sapiens
ggcagaattcatgaaagcgtgacctggtatatgagtcaataagaattgtttcatgttggaccaggtgttattccttcctccttaatctttcttgcaagtttgttgataaagagagggatctcatgatttctgctctgacaacctcccaggcacaagggctgtatttcttctctgtcagatagagagtgattcttcggaagtatttcttcacagccaagatggagtccgcattcatcaggggagtttctcccaccctctcctcctgcatcacacaggcttccaagtcattcagctgctggtagagttcggtgcagaatttgtctaggaggtcctcatcccaagcagcagatgaatcttttgtggtaaagaggttgaagatctgctggatcagctcatggaggacagagatggctggagccttctggaactggttgccatcaaactcctcctggggaaatccaaagtcatgtctgtccatcagacaggaggaaggagagattctgctcatttgtgccaggagcatcaaggtcctcctgttatccaggctgtgggtctcagggagatcacagcccagagagcagcttgacttgcagctgagcaccaccagggccatcagtaaagcaaagggcgaggccatcatagatattgcagatgcttctgggcttgctgagatgggtgactctgaaccttgggctctaggttctct

SEQ ID NO: 1152 - DNA, 1475 bp, Homo sapiens
tttgaagaatcaaccatattaatgaatttattttgacatacaaacaatttaaaatggatagaatatataaagccacattacaaaataaaaacaattgtggtcaatatgcacaatcttaaaacacagataaatatatatatacacaaaatcaaagcaatgtgattgtactataaattgtattaccactctatgaagaatcatgtctggagaagtcctctagtccctccacctacctcgggcttctaaactctgtagtaagctcttgcttcatgtcgttcaagggtcttccttgtttgctcagtttttctgtgagactgaacacaaagaacagacatcggctgatttctacttggacaatggcccaggcacaggtgctgtagtcctggttttccaggtaatcatggatccttcggaagtacattttaacttgtaatctaaggttatcactacccaaagtaccacttagcttctctgcttccagtcccatgagtgcttctaggtattctagctgttgatgaagttgaatgaggaatttctccgtgtggttttcctcccaaccatccagagaaatatttgccctgaagaggctgaagatctgctgaagcatctcatggagaatggccagagtgtgtcctttttggtactgctgaggactcaaagacttctgaggaagcagaaagtttttcctgtgtggtagacactgctgaattgacaaggtttgcaacttattcaagagttttaaactttcttgattcacttgtctttgctggaagataatcagtttcaaatctagagagaagatagtggtagaggccagcagcaccaacacagttccaaagaagtgcttgataatcatggtgaaggtcaaatatgctacttatccctgcatagacttagggaaattccagctctagtgaatgtttgcctttcatgcatctcagattattttggagagtgttctcttttgttgctttcgttttctaatgtcatttctccaagtttacacattagattttcaggttcccttttcatggtgttcagagtacattttctccatttccctattgtgttggctattttgaggaagtaccaaaataacttattcattgtatgctttccttgaggcaattacagactagtcatccaacataatcttttattattctattcattatatacaaagtttcactgaacacaatgtgctttctaaatatttagtcaagcttattaaagttcttttattgagattacgtttttttcagtaatagtctttcatggagtaaaacttaccaaaggcttatcagcacctataaagaattcaggggcaaaacttaaaatacctacaaactactaaatttaaaacctcaattagaactgtaaattgtcacaaatgcttgagcaaataattaattttaaaacatatatcagcaatcttaaattattttatatcttatcctatcagtttaatatctaag

SEQ ID NO: 1153 - DNA, 1040 bp, Homo sapiens
aaccagctcagcagcatccacaacatctacaatggccttgactttttatttactggtggccctagtggtgctcagctacaagtcattcagctctctgggctgtgatctgcctcagactcacagcctgggtaacaggagggccttgatactcctggcacaaatgcgaagaatctctcctttctcctgcctgaaggacagacatgactttgaattcccccaggaggagtttgatgataaacagttccagaaggctcaagccatctctgtcctccatgagatgatccagcagaccttcaacctcttcagcacaaaggactcatctgctgctttggatgagacccttctagatgaattctacatcgaacttgaccagcagctgaatgacctggagtcctgtgtgatgcaggaagtgggggtgatagagtctcccctgatgtacgaggactccatcctggctgtgaggaaatacttccaaagaatcactctatatctgacagagaagaaatacagctcttgtgcctgggaggttgtcagagcagaaatcatgagatccttctctttatcaatcaacttgcaaaaaagattgaagagtaaggaatgagacctggtacaacacggaaatgattcttatagactaatacagcagctcacacttcgacaagttgtgctctttcaaagacccttgtttctgccaaaaccatgctatgaattgaatcaaatgtgtcaagtgttttcaggagtgttaagcaacatcctgttcagctgtatgggcactagtcccttacagatgaccatgctgatggatctattcatctatttatttaaatctttatttagttaactatctatagggcttaaattagttttgttcatattatattatgtgaacttttacattgtgaattgtgtaacaaaaacatgttctttatatttattattttgccttgtttattaaatttttactatagaaaaattctttatttattctttaaaattgaactccaaccctgattgtgcaaactgattaaagaatggatggt

SEQ ID NO: 1154 - DNA, 1144 bp, Homo sapiens
ctggtttacagaaagtttatttttacttatatcttgaatataatattgatggataaatgaagtgtaccagttattctgtaatcaggttgcacaattaggcttggaatttcattttaaagaataaacaagtacaaaagtttccatagcaaaagttcaatgaacaacacaaaataaatttaccaaatacaaagaacatattttattacattaaccactgtgcaaaggtgcacatgacataatatgaacaaaaataagttgttttataaatagttaaataaataatattttaaaaatatttaaatagataatggatcagtcagcatggtcctctgtaagggactagtgccttaagagctgaatacaatgttgattaatactcctaaaaacatttgaaaagatttaaatcgtgtcatggtcatagcagaaacatgagtctttgaaatggcagatcataaaaaggtgagctggcatacgaatcaatgaaaatcatttccatgttgaaccagttttcattccttacttcttaaactttcttgcaagtttgttgacaaagaaaaagatctcatgatttctgctctgacaacctcccaggcacaagggctgtatttcttctctttcagatagagagtgattctttggaagtatttcctcacagccagaatggagtcctccttcatcaggggagtctctgtcacccccaccccctgtatcacacaggcttccaggtcattcagctgctggtagagttcagtgtagaatttgtctaggagggtctcatcccaagcagcagatgagtcctttgtgctgaagagattgaagatctgctggatcatctcatggaggacagggatggtttcagccttttggaactggttgccaaactcctcctggggaaatccaaagtcatgtctgtccttcaagcaggagaaaagagagattctcctcatctgtgccaggagcatcaaggtcctcctgctacccaggctgtgggtttgaggcagatcacagcccacagagcagcttgacttgcagctgagcaccaggagggccaccagtaaagcaaaggtcaaggccattgtagatgttgcagatgctgctagactggttgaaatgggtgagcctaaaccttaggctccaggttctc

SEQ ID NO: 1155 - DNA, 72 bp, Homo sapiens
aggaaagatggcaatatgttggcatagcaggttcccagttcaacagctatgccagcatcttgcctcctctcc

SEQ ID NO: 1156 - DNA, 63336 bp, Homo sapiens
tctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaaggtgagatgagccctcccagccgcagcggttcgccctgccggatgccttctcgcccccgcgccgggggaccgcgcctccgggggccatgcgcccggcccgtgcgtcccttgccgccgcggggagggactggggcgcggcactcgggactcacttgccgcgcgaggagagggtacgcttgcaaatgatccccctgccgcaccgccaacacacacacacacacacacacacacacacacacacacacacacacacacaccaccttttggcttatctgcacccgcaccctgtagggcgtaggcacccctttagagagagaggtcgtggatgggagaggctgcacccatgccaccaccattcctgagaaccactcttcttccaagaaagacacccggctggagtcaggaggtgtccgggcgcctgcagcttctgtgaccgtctcctggtgccttgcgggactccagcttccgctctctgactctgcttgttgcctgcggcccacgtgggagaactgcttacttgctcttttgtatgcttccggcttctttttcctccaaacgtaggccttctccgcgctgaagttttccccagcagcgtaatactgtaagaattctgagactttcttcgaaaaggagtacaggcgtccgtttttagggctgcactgtttggaggcctctggcttgaaactgctttgttttgcagccttgcaagttagagttcaatttccttgtgccctaggccctgagaggccttgatacaaggggtcattgtgcggtgggaagctttgtgctgaggagggcacgagttctgagagtagcagctggcttccctggggttttaaacacttctctcctggttagtattccgagagagaattacagcacgtaaagaaaaattgatgataaaacttaagacctcttctaggcagtttattactggctaagaatgcgttcttgtttgatttttagaaatttttggcctatgggataggaaggtctgcgatcttctccaaagcatctcgattccctacactcgactgcagttttcccgggagaaggcgaatttctgcggtcagtgtgtaatcagccagattagtttattacgcccttgcaggtttaaatgagccacttagaatgagaggaatggtgaagggtgttgcatccagacttatatatgaaacttattttgtcattttgaaaagaatcttgcatccagcaaatatttatagaaggcctctcccctgccttcattgtttggcggaaacaaggcagaaatggttttcatgaaactcgtgtgaagtatgtgacttctcttaggtgctcatctataaactgagaattttactgcagaatttgctaggagggctagaattatattgtctatgttgcacatggtagaagcttattaagtggtagtgcttataagtgggggaactgagattaattttgaatgatcttttccccaaaaattattaagttattgtgttaggtatcattaggccacaacttttcaccttatccttgcaggaatacacttcaagcgccattaaaaatggagaaatggtgtttaaaacagtcttactttaatctggttagcattctccctgccacagggtttcccttcaaattaatgcagtgcatttaagtgcagaatgggcaatgggattctcagagacctgatgtaaatattgaatagtgtgtatttttggtcttggcaagcttctggatataaaattaagaggtacatatggtgctaggactgcctgctgatttctcttttaatttagaacagatgacagctttgccgtagagattccatgatgccagcaccgtattccccagacttctaaggcaacattctgtatagaagatgtgaggtgccagtgtccagagcaaaataggttaataaaaaccacatcctattcccaaattatagaatgatggggctggagtgttccttcaagaccatccatatagccacacaaacccgttttgcgggtgtaaagttgaggcccagaaaggtcagctaagtatccagaattacacagctggacctagataatgacagaattgggcctagagcctggcattccaccaactagatgtgaggcatttctgaaatctgaagtgtggtctctgccctgttttcttgtgacctaatgcacaattaaaatgagcacttgatagaatgtccatcttgaagagggaggcagagggtatgcagaaagcaggctgcctccagtgcccactgcacaccacccaggtataggtataggaggcacatgtgtgtctgaaccccattggtgtcactggcaggtcctttgagaggttgctggatttaaatacagtaacatgtaacacactcagcccagttccaggtactcctttaatgtcagcccaagtacctctcttcttaaaatagagatattaacggggtggatcttaaattcattctcaattttagaggtgcagttaactcatgcaagtgaaagattccactgagttttggattggcagtatatttggcatatctttcaaatctagccatctactggtggaatcctattcaaaaatatttattgaatacctgctagacaatggggatgcagctttgagtaagcgaggcctttatttattttcttcaagtttatattctagtcagggtgggaaaccaactgacatgaaagtgaaacagcagtaagattccattgggtgaggggtgtcagaaaagactcctagggaggtggattttaagctgtgcagtagtctgcctccaaaatctgtatgttgaaacctaatcgccaatgtgatggtattagaagatggggcctttgggcgtgattggggtcataaaggtggagccctcatgaatggaagcagtgcccttacaaaagaggccccagagagctgccttattccctctactaagtgagaggacaccatctatgagccaaaacgtgggccttcctcagacactgaatctgctgtgaccttgaacttgctaagcctccagactatgagaaatttctgctgtttataagccacccagtcctaagatattttgttatagcagcctgaatggacttaagctgatagtgaaaatagggataaagggtaaagatccaagtgaagacctgaggagagagatgggggtaggagagcgaaaaccaagatgtcgcagaagtgagctcagtgtggtaggaatggaaatcacggatgcacagtgagaattgggtggatgcagctcataaggccatccttgtagaccgcgatcaagaattttgattttaaatgttttggaaactgttgaagggttaagagtgggaggcagcatttgatttacattttaaaatgattactctggctgttgtatacagaatagcctgtgggcaggggaagagctaagagatcaggccagaagtcttggtgctggggctgaagtctagggtgggagccatggaggtggtgaggaataatcagattggggatagaatttgcaggtagaacacagagatggataagatgtggggagtgcaggaagaagaacaggatgatttctgcttttgacctggaaaaccaaaaagatgatgatactggtggatcatttcaaagtgggcgataaggggccacgagtgactccttggagccaaggagggtgagtgtaggattccttcctcccagatactgctggttagggggccagaggctgggatgctgaggggcctctttgctgtaggagcagagtgggtggcaggttgagggagggaggaagccacctggagtgagagtaattcaagcaatcttttttgtggttcactgcagtgagagatggtccaggcagggagtgaggatattacctggggggtagccatggagagaggcagcaggagccagaggctatgggattaacactgccattgtctgagaggacctcagggagacattgtcctccagcatcagccaagggcaggtggtattcctgacagagggccaaaccagtctttggcacccagatacagggcattctggagggctcctgcagtgtaccatggctcccctgggcagcctcccagctttcattctgggagattaaaaataagacttggccaggcgcggtggctcatgcctgtaatcccaacactttgggaggcccagctgggcagattacctgagctcagaagttcaagaccagcctgggcaacatggtgaaaccccatttctacaaaaaatacaaaaattagccaggcacggtgctgcacgcatgtaatcccagctactcaggaggccaaggtgggcgaatctcttgagcccaggaggcagaggttgcagtgagcagagactgcgccattgcactccagcctgggcgacagagtaagatcctgtctcaaaataataataataataacaacaacttgttaatcatggttgctgtgacaaggaggggatatggtcccattgtaggttggtagtgagctatcaacataatgatattaagggagatggacaagtcatggtttgtagactgtggaatatgggcctttacactccctgctttgctgtcttgagtgtggcctgcaagggccttcagcctgagagtccttgtgtggctatctgaaactgaggacaacctgcaggccccagttgaaaatcacatgaccaacaagccttcattttttttgcctagggacacaagggcattttgggcaggacaattatttcttttgtaggactgtcccaagcattgcaggacatggagtacaacccttaacctcctccacagaaatgccagtagcactccccctagtcatgacagccagaaatagccctgtttccagatacccccaggagagctgtttgacatttagttgaggaccccaaggctaaatcccaaaaaagactacctgctgaagagaggtaggagcagccaggttttgtactgctcagcagagtaaaaggaggaaataagggctttttttgttgctttgaggaagtttattttgattttttatttttgccaggagtggtagggtatacagaaacagagactgatggtaatacattatttcattttattctcttgataattttatggattagtaaaaatcttaccctataggtacagctgaggaagcagttaaggaaaatgtttgtatgcagtggattctggatcctcacctgtggttgtagtcatggcattccagcctgtgcctcaaaagcatctaaagcagtggttctcaaagcgtgtcatgcattcatatcacctggtcatttgctagaaatgcaagttcataggccccaccccagtcccagtgaatcagaaactctggggctggggcccagcaatctaggttttgacaagccttagaatattcagatgtccaccgaagtttgacagccactgacctagagagctttggaaagggtggccatctacatttttaacaagttcttcccttagtgttatagtttcctgttgctgctataacaattttcacaaatggagtggcttaagacaacacacatgaggccgggcatggtggctcatgcctgtaatcatagcactttgggaggctgaggtggatagactgcttgagctcaggcgttcaagaccagcctgggcagcatggtgaaacctcatctctgcaaaaaaaaaaaacaaaaaaattagccaggcgtggcggtgcacgcttgtagttcagctccttgggggctgaggtaggagggtcacttgaacccaggaggttgaggctgcagtgagctgagatttcaccactgcactccagcagcctgggtgacaaagtgagactctgtttccaaaaaaaaaaaaaacacacacacacacacacaaacgtattctcttacagttctggagtccacaaatccaaaatgagtcttacagggctaaaattaacatgtgtatcgggctggttcctcttagaaaaaccatttccttgcctttttcagtcttctgaacctgtagaaccatgagctaaataagcctcttttctttataaattaccctatctcaggtattctgttatagcagcagaaaacagactaagaaaaatgttgtgcttgtaagagattgggacacggacacatacagagggaagaccatgtgaagacacatggagaacgctgccatctacaagccaaggagactgaccttagaagaaatcaatcccaatctcaccttaatgttggacttctagcctccagaactgtgagaagataagtttctcttgcttatggggaaaacctatttccttgcctttttcagcttctggaggcaccagcacttcttggcccatggccccacatcatgtccccttttctctccctctgcttctatcattatatcactttcttcctcatttgaccttcttgcctccttgtgatttcatttaggtcccacccaggtaatctaggataatctccccatctcaagatcctggatttaatcatatttgaggtaacattcccaggttctgggaattaggatgtagctaggatctcttgggacaggggcattgttcagcttgccacactcagcccacgttttaaaaatttatggtctaggggccgggcgcggtggctcatgcctgtaatcccagcactttgggaggctgaggcgggcggatcacaagatccgaagattgagaccatcctggctaacatggtgaaaccccgtctctactaaaaatacaaaaaattagccgggcacggtggcagcctcctgtcatcccagctacttgggagactaaggcaggagaatggtgtgaaactgggaggcggagcttgcagtgagccgagatcgcaccactgcactccagcctgggcgacagagtgagactccgtctcaaaaaaaaaaaaaagaaagaaatttatggtctaggccctagagcaggttgcttagttctgagggcactttagaaccacctgcggagctttaaaaacaaactacgccttgcccaactaatcagaatccctgaggcctgggctttggtattgaaagctagagaaggggaatgtcctagtatccagcagctggttcaggagggtgggtggctcccactgttgctccacaggcaaaggagagctctaacaaagtatgcattagggagagtcctcctctaaaaatatctggccatttcagcaggtgaagtgtgtctttaagagggtgtctgccctttagactgatatctgtacttctcaaggggcatttgctcaaataaaaaccatggatgttttgagcgcttgcatcatccaagcttctctgactaaaatatagagtcactgtattagttcgctaggcctgctataacaaagcactacagaatgggtagcttatgcaacagaagcattatctcctcacagcgctggaggttagaagtccaagatcaaggtgagatcaaggtggatttcttgtaaggtcagtctgcttggcttgtacatggcaatgttctccatttgtcttcacagggtcttccctctgtatgtggttatatcccaatctcttgtaaggacaacagttttcttagtctgttttctgttgctataacagaatacctgagacagggtaatttataaagagaagaggtttatttaaaagaaatgaaagggagacgagggagataggaaaaggaaacaaaaaagagacaaactttgcttcataacaacccactctcactggaactaatccaacccaatgagagcaagaacaccctcccctgggactgcatgaatcccttaattggggtggattattaccatggctcatgactcaaactcctcttaaaggtactacctcccagcatcactatatttggggaccaagcctcaacatgagttttgaagatgaccacattcaaaccataacatgaggtatactgcattagggcccatcccagtgacctcatttgatctgaattacctctttaaaaacggcaaatacagtcacattctgaggtactgagagttggaacttcaacctatgaacttaggggagatacaattccatccataaccattacctacaagggtggcctacagagggggtgtcttgtcagagatggagaccccagctatccctgtggaccctattgcaggtttttaacagtcctcacagcctgagacagttggttgctccctctcatacagctaggcttccaggattttgcaaggccctgacaggcctcaaagccatgtcagcctaataatgagggcctccgtctgctgtgcttgccaaaattgttatggcaaccagagctaaaggactgcagtgctcagatcgggctgtgccagctccagctctggctcgcttaccttatcgtgagcttgaggcactcagaggcagcccatctccctggcatgagctagtctcaaccgcttggggtgatggtattttgaaaatgccattatagagtgctgggttccttacggcagtgtgcccaggcctcaaagtgatggtgaatggtttctgggacaaagaagggttggtaaaatctcctgtagccaggtactagaagaaatagacagagtaggggttactatgcaccctttccacattgctagaagtaactgttctgaccaggtgaactggtatttggataaatgctttcacagtctcagagaagtcagacccttggattgatttgctcttgaacaaaaaaattttttttttcactgtgaaaatgctttctttggggtgtctttagaacatgtgatgtcaagacacaacagcaagcgcacatacactaagacatggctgtcatagaacagattgtgcgtgaataaagggttcacaccacttccaccctttacacagtaacagaaggctctaggccacctacctcctccttggctcactcaaactcttcctcctcagccgtggcctcctgctactgctggtactcagacaccaggtcgttcatgttgctttcagcctcggtgaattccatctcatccatgccctcgcccgtgtaccagtacaggaaagctttgcaccgaagtatacctgtgaactgctctgagatgcccttgatcagatcctagatagcagtgttgttgccagtgaaggtggccggacatctttagccctgagggtgggaagtcacacacagctgtttttatatcttgggggatccaaccaacaaagtagctgctgttcatattttgggcattaagcatgtgcatgtccacctccttcatggacatgtggcccctgaacatggcagctaccattacgtagcaaccatggcagaggttgcaggcagccatcatattcttggcatcaaagaactgccaagtgggctcacgcaccatgagggcccagtactgctggttgtcccagctggtcagcagggggaagccatacatgaagtgcaggtgggggaacaggaccatgtttgcggccagcttctgcaagtcagcattgagttggccagggaaatgcagacagatggtgaccccactcatggctgcagacaccaggtggttcaagtcactgtaggtaggtgtgggcagctttagggttctgaggcagatgtcatagagagctttatttattatcattgcagaaggtctagttttgagaagtttggtttgatggtcagtccgtggaaaagtgtggcatgagccactagcttttaaaatctgtcaaggaccttgattgactccctatttcagaactctatcttgtgtaataaagaagtcctggctgggcagaaattccatctcaggtcttgaacacatttcctacacagtctagaattaactggactgaggactgacgcttcctgcccaggaggcctggcaaggtcttgtcattgtttcctgagggtggatgaggtcattaagaaagagttttcctcccctctgagatgattcactcagatacctggagtcactgtttctgtgcttgttctgtgaccttcgtcatgaacttgacctctctgagcatgttgtctcataacatggagacaaataacttttctaataaggtataatgttatggaggactccaggggatattgggagagggcacatcatagtggttaagcctgaaagacctagatttgtatcccagctttgctccttatgattggcccctggacgaggtttttaatttttgtgcttctctttcttcgtttgtaaaacgggtaacattctatagggcccatcttatggtcctgatgatgaaataaggtaaggccactgaagcacttagcacagtgcctttaacatgtaagtccacagacacagttactttataactaaggcagtactgagttgacacaaacttagagactcaaaggaatgtggatagaattgggccatcagtgcttgggtacttcatcccagttgtactttgctgtggagccagcaggtggcgacattggccacatcttggccctgctggcctccatcttagaggtccagtttcctgggatggcgggactcagttgctacacttgtccctgtatccctcgcacaatgtaggtttccgtaaacaactggacctagtaaagtgactggatgggcttgcctgcagatcattccagagcagtagccactcttgctttcatgtccagggctactacatgttccttgctgagggctgagttgccagctacctggtgcagagtcattatgcagccaggtggtgcagactgaagcttggggttgctgagagtgagctcaggggctctgaaattcagcgggacacctggttagcatttctcaacaactgctacaatgctgggcaagttcacctaaactcagagggtggctccaaacaaagcccaactcgatttgtgtatttgatcccgagcatccagtgttgaatccagaatctgagatgccctggctcagggaacacccagaaacagccaggccaaagtggtgataagttaaaaagctagtagctgaatccccagggagctggctgagagtaatttcagagtcagcagttcatatctgtgtcccaggtgaggatatgggctggatggtttcttagcctcctcatgacctgtggtgcttcagaggtccacggaatgaaggataagatggagaagccaggctaaggaaggattgggatttcctaaaacagtatgaatttttgttattttctattgaagtgccgtaatttaaatgtattgacttaagtgaacacttctgttgatttgaaagctataatactggttactctttgttcgttgacataaaagtatgttaacctgctgtggttttaataatatacctccacaagatggcgccaacatcaaagcctggctttgccacttaaggaaattgtggtggacagtcacaaattatgtaaccatgtcatgggaaacaggcagagttcttcagtaaaaacctcactaaattgtccttattttcttgtttgttttttgttgttgttgctttttttgtgtgtgtgttttgtttttttcaggaaactgagccagaaaggtaaccatttttttacgtgttgataggactcaacttgtgtaacctgacctgaaaattatttaatgcagatgttcactgaattcttaatcctggaatttttttcttgaggcctactttattttatttagttacccttgtgacaatagatttaaagcttttcattgaaaaacaacaatgctcaggtcacttcgcattaattaggtttctaataaagttagcctggcactgtttactctctaggaggtaccagcccaaggaaatttccctaatgatttgttacttatttttagttttaacagtttagttaatttttatttatttttgtaattgttcttgtttgtctttcttaatcatcaaattagatcaactctcagaggatagtgctaggtttctttaactcagacaaggactttcaagataatctctgaaaaatgcaatacaatgcatgaacttaaaaaaaacttataactaccttttgaattatttatatttgcataaatgtatttactgagtaatatacatgagtatgctatatgtatatttacaacatgtaaatatgaatttgcatacatatatgaatgattgttttcataaatgtatatgcgggtaacttttcatgcaatttcagtctcctctgtctgcattctctcctagctctgtgattctaatggcgtgggaaagataatctctcatttctttatcaaatagaacagtgaggagaaatcaataccaaatggaatacctaatattttatatcccagcagtcttctgaacattgtttattctatagtccatttgacagagaaacaaaattgatcagaaggtactttccactaccatacttgcctacttttaggtttgattttctaccttgagttggttaaaatacctctctatgctgacttgtaattcagacagtcagaagtaaatgtgatgtagtccaaaaaggtgccctacgttttggttacttatagaatatagaaggccttcaaatgtttgttgatttttatggaaggctttgaaatatttgttgattgatgttcagtaattttcagatttcaaaaaaataactagggcttggcaggaatggagaagagcatatgaataaatgaatttgcttagaatcttatttctaataaaaattaccaaatacaataatcttctctgtctttttctctcttagattggaataattggtggaacaggcctggatgatccagaaattttagaaggaagaactgaaaaatatgtggatactccatttggcaaggttaatatccaacttgtggagacatgttttttagttttttcatttctccttgctggcttgatttttgaattaaaaaaaaaaaaaagaattgcttttgttttggcagcccagggctgtctgctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccacagactcatttcagactgtacttttcaaatctacattcaaatcttctaatttgtggccaataggtcacaccacactaattaggggacaggctgatgactaataggatgaattattgttacgaagcggcatttgagtggaaagaattgttttggggaattagaacatacctgatgttagttgaatgtgtaactgagctagaaataaaatgctcctccttttataggagaggttgcttgttctccaagcccatgtcactcagcctaggccggggtgagggtgtctgcattctcctaattccatattgctacgtcctctggtccatctgtaagatctctctatctggctgtcccaaccaaaccctccttttcagctaaattcttaggttgaccttgtgtgctcccagtcctgcagtcatcctggttcattttcttaaacccctcggttctaagggtctttccagcctttgttacctcaagtcatttccatgatcatcttagacctggttaacacaagcagacatttccagtgctgaattcttagtgtcatgatggtggcttgttatcctttctgcctttcaccttcacacctgttctcaaacctgcccaataaccttgacacatctaaatttgaccagtctaccatcagagttccctggggtactcgttacaaatagatctgactaaatggtacctacacaggtgcccatggtaaccttgagtcctgtgaatctatgcctgcagagggatcaataagtaattgattaaatgattatattgataatcagatcttgcctcttctctaagttgtatcctcagactcttcagattccatgagtcctgttgtggttgaacaattataatttacatacctgtttttaaatcactgagttaaatgtcattttttcattgcatgcagccatctgatgccttaattttggggaagataaaaaatgttgattgcgtcctccttgcaaggtatggtattttaagctttttggatgttactactaaaggataatttaaatttaacttaaattctggaaagagtaaagatacaggtctgagcttttatatgttggcagaatcagaacatcttagtaacctttatttacaatgttttatttttggttaagttatattgacttaggagatcaaagatctcatgctcttgccccttacattgggaaagtagatcagatgactaaaatcaaagctctggttttagttctaactgcaagaagaaatgttttgttcatttttttcccccttcttataaagataaagaaaaacaatgcatcattaatgacctcttgctggtagtagttatatgtctgtgggaagtaggcttagggcttctgaagtgggttacttgtgtctgtgctgttgtttccttaaggaggctggtgctgctccatattacagaggaggccaagtcatttttatcccattgttagaagttagtcaagatatatgtatgagttctctactgttgtgtaacaaattaccacaaatttagcagcttaaaatagcacacatcatctcctagttcctgttggtcagaagtctggcacagcttagccagtcctctgcttggggttgcacaaggccccacaaggcatattcaaggactgagtccccatctggagcttgaggtccttgttcaagctcgtgtagttgtaggagaattcactccctagaagttacagggcggaggcctttggctcctagaggtggttcacattccctgccgtgtggcctgctccacaggctgttcacttgactgcagcttgcttcttgctattaggatatggcaaaggtgctagaagtcacctccatggttaagctgtaccttgcaagcatgcaggagtccggcaggagaatctcctatgcatgcttgcaaggtagagcctaatcgtgggagtgacttatagcacgtttaccatttttctattggctgaatgcaagtcccaggttcactgatcctttatacagagcatgacagtggggtcctcactagggtctgtctgccactctacatatttgaaacaggagtggcttctcagaatccagtgaacctaaattttagttttagttgctcactggactgggttctaggagaccccctgtgttagtctgtggtcattgctagagaatcacttaattttttctagactctaggagaaaacagttggtggtgtactcatcacgggttaacaatttcttctctccttccataggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggtaagcagtcatacaaaatgctttaggctattgtagctggtcattttcagctcaaatggacgacgcgtgggaaccggcagggcaactgggagggcagtgccacagactcgcttgctttttttttttttttttttttttttttggagacggagcctcactctgtctcccaggctggagtgcagtggcatgaactcagctcactgaaacctccgcctcccaggttcaagcaatgcttctgtcttagcctcccgagtagctgggactacaggcacatgccacaatgcccagctaatttttgtatttttagtagagatggagtttcgtcatattggtcaggctggtcttgaatcaggagatcacccgcctccgcctcccaaagcgcaaagtgctgggattacaggcgtgagccactgcacccagcctgtgttaagcttttcattgtgagtttttgttttttaattttaattgacaaatgataaatgtatatatgaggtataacattatattttgatatatgtatgcattgtacaatgattagcaaagctaattaacatattaccccacatatcatctttagtggtgagaacatttgatttttactttaacaattttgaaatacataatacgttgtcattagctataatcaccatgcagtataatctcaaaaacttattcctcctgtctaactgaaattttgtgctttgatcaacgtctccccaaaccccagcccctggtaacctttctactctttacttctatgagtttgacttagttagattccacatataggtgagatcatgcagtatttgtctttccatggctggtttatttcacttaacataatgtccaggttcacccatgttgtggcaattgacagagttgcgttctcttttaaggctaaatggtattctgttgtgtatatataccacattttcttttttttttttttaattgtacttttaagttctagggtacatgtgcacaacgtgcaggtttgttacatatgtgtacatgtgccatgttggtgtgctgcacccattaactcgtcatttacattgggtatatctcctgatgctttccctccccactcccccaaccccacaagaggccctggtgtgtgatgttccccttcctatgtccaagtgttctcattgttcagttcccacctatgagtcagaacatgcggagtttggttttttgttcttgggatactttgctgagaatgatggtttccagcttcatccatgtccctacaaaggacaggaactaatccctttttatggctgcgtagtattccatggtgtatatgtgccacattttcttaatccagtctatcattgatggacatttgggttggttccaagtctttgctattgtgaatagtgccgcaataaacatacgtgtgcatgtgcctttatagcagcatgatttataatcctttgggtatatacccagtaatgggatggctgggtcaaatggtatttctagttctagatccatgagaaatcgccacactgtcttccacaatggttgaactagttcaccttcccaccagcagtgtaaaagtgttcctatttctccacatcctctccagcacctgttgtttcctgacattttaatgatcaccattctaactggtgtgagatggtatctcattgtggttttgatttgcatttctctgatggccagtgatgatgagcattttttcatgtgtcttttggctgcataaatgtcttctattgagaagtgtctgttcatatcttttgcccacattttgatggggttgtttgatttttttcttgtaactttgtttgagttctttgtagattctggatattagcccttagtcagatgcgtaggttgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttccccatgcctatgtcctgaatggtattgcctaggttttcttctagggtttttatggttttaggtctaacatttaagtctttaatctatcttgaattaatttttgtataaggtgtaaagaaaggatccagtttcagctttctacacatggctagccagttttcccagcaccatttatgaaatagggaatcctttccccatttcttgtttttgtcaggtttgtcacagatcagatgcttgtagatgtgtggtattatttctgagggctctgttctgttccattggtctatatctgttttggtaccagtaccacgctgttttggtgactgtagccttgtagtgtagtttgaagtcaggtagtgagatgcctccagctttgttcttttggcttaggattgtcttggcaatgttcatggttccatatgaactttaaagtagtttttcccaattctgtgaagaaagccattggtagcttgatggggatggcactgaatctataaattacctatggccattttcatgatattgattctacctatccatgagcatggaatgttcttccatttgtttgtatcctcttttatttcattgagcagtggtttgtagttctccttgaagaggtccttcacaacccttgtaagttggattcctaggtattttattctctttgaagcaattgtgaatgtgagttcactcaagatttggctctctgtttgtctgttattggtgtataagaatgcttgtgatttttgcacattgattttgtgtcctgagactttgctgaagttgcttttcatcttaaggagattttgggctgagacgatggggttttctaaatatacagtcatgtcatctgcaaacaaggacaatttgattactcttttcctaattgaataccctttacatctttctcctgcctgattgccctggccagaacttccagcactgtgttgaataggagtggtgagagagggcatccctgtcttgtgccagttttcaaagggaatgcttccagtttttgcccattcagtatgatattggctgtggggttgtcataaatagctcttattattttgagctacgtcccatcaatacctaacttattgagagtttttagcatgaagggctgttgaattttgtcaaaggcctattctgcatctattgagataatcatgtagtttttgtctttggttctgtttatatgctggattatgtttattgatttgcgtatgttgaaccagccttgcatcccagggatgaagcccacttgatgatggtggataagctttttgatgtgctgctggattcagtttgccagtattttattgaggatttttgcatcgatgttcatcagggatattggtctaaaattgtcttttttggttgtgtctctgccaggctttggtatcaggatgatgctggcctcataaaatgagttagggaggattccctctttttttattgattggaatagtttcagaaggaatggtaccagctcctccttgtacctctggtagaattcggctgtgaatccatctggtcctggactttttttggttggtaggctattaattattgcctcaacttcagagcctgtttgttattggtctattcagggattcaatttcttcctggtttagtcttgggagggtgtgtgtgtccaggaatttatccatttcttctagattttctagtttatttgcatagaagtgtttatagtatgctctgatggtagtttgtatttctgtgggatcggtggtgatatcccctttatcattttttattgcatctatttgattcttctctcttttcttctttattagtcttgctagtggtctatcaattttgttgatcctttcagaaaaccaactcctggattcattgattttttgatgggttttttgtgtctctatctccttcagttcttctctgatcttagttatttcttgtcttctgctagcttttgaatgtgtttgctcttgcttctctagttcttttcattgtgatgttagggtgtcaattttagatctctcttgctttctcttgtgggcatttagtgctataaatttccctctacacactgctttaaatgtgtcccagagattctggtatgttgtgtatttgttctcattggtttcaaagaacatctttatttctgccttcgttttgttatgtacccagtagtcattcaggagcaggttcttcaatttccatgtagttgagcagttttgggtgagtttcttaatcctgagttctagtttgattgcactgtggtctgagagatagtttgttataatttctgttcttttacatttgctgaggagtgctttacttccaactatgtggtcaattttggaataagtgtgatgtggtgccgagaagaatgtatattctgttgatttggggtggagagttctgtagatgtctgttaggtccgcttggtgcagagctgaattcaattcctggatatccttgttaactttctgtctcgttgatctgtctaatgttgacagtggggtgttaaagtctcccattattattgtgtgggagtctaagtctctttgtagatctctaaggacttgctttatgaatctgggctcctgtattgggtgcatatagatttaggatagttggctcttcttgttgaattgatccctttaccattatgtaatggccttctttgtctcttttgatctttgttggtttaaagtctgttttatcagagactaggattgcaacgactgcctttttttgttttccatttgcttggtagatcttcctccatccctttattttgagcctatgtgtgtctctgcacgtgagttgggtctcctgaatacagcacactgatgggtcttgactctttatccaatttgccagtctgtgtcttttaattggagcatttagcccatttacatttaaggttaatattgttatgtgtgaatttgatcctgtcactatgatgttagctggttattttggtcgttagttgatgcagtttcttcctagcatcgatggtctttatattttggcatgtttttgcagtggctggtaccagttgttcctttcctccaggagctcttttagggcaggcatggtggtgacaaaatcctcagcatttgcttgtctgtaaaggattttatttctccttctcttatgaagcttagtttggctggatatgaaattctgggttgaaaattcttttctttaagaatgttgaatattggcccccactctcttctggcttgtagagtttctgccgagagatctgcttttagtctgatgggcttcccttgtgggtaacccgacctttctctctggctgtccttaacattttttccttcatttcaactttggtgaatctgacaattatgtgtcttggagttgctcttctcgaggagtatctttgtggcgttctctgtatttcctgagtttgaatgttggcctgccttgctagattggggaagttctcctggataatatcctgcagactgttttccaacttggttccattctctctgtcactttccggtacaccaatcagatgtagatttggtcttttcacatagtcccatatttcttggaggcttcgttcatttctttttactcttttttctctaaacttctcgcttcatttcattcatctgatcttcaatcactgataccctttcttccagttgatggaatcggctactgaggcttgtgcattcgtcacgtagttctcgtactatggttttcagctccatcaggtcatttaaggacttctctacactggttattctagttagccattcgtctaatcttttttcaaggtttttagcttctttgcattgggttcgaatttccttctttagctcagagaagtttgattgtctgaagccttctctcaactcgtcagtcattctccatccagctttgttccattgctggcgaggagctgtgttcctttggagggggagaggtgctctgatttttagaattttcagcttttctgccctattttttccccatctttgtggttttatctacctttggtctttgatgatggtgacatacagatgtggttttggtgtggatgtcctttctgtttgttagttttccttctaacagtcaggaccctcagctgcaggtctgttggagtttgctggaggtccactccagaccctgtttgcctggatatcagcagtggaggctgcagaacggcgaatgttgctgaacagcaaatgttcctgcctgattgttcctctggaagcttcgtctcagaggggtacccagccgtgtgaggtgtcagtctgccctactggggggtgcctcacagttagcctactcggggttcagggacccacctgaggaggcagtctgtccattctcagatctcaaactctgtgctgggagaaccactactctcttcaaagctgtcagacagggacatttaagtctgcagaggtttctgctgccttttgtttggctatgccctgcccccagagttggagtctacagaggcaggcaggcctccttgagctgtggtgggctccacccagttagagcttcccagccactttgtttacctactcaagcctcagcagtggtgggcgcccatcccccagccttgccgccgccttgcagtttgatctcaggctgctgtgctagcaataagcgaggctctgtgggcgtgggaccctccgagctatgcacgggatataatctcctggtgtgccgtttgctaagacagttggaaaagcacagtattagggtggcagtgacccgattttccaggtgccgtctgtcaccccttccctttgctaggaaagggaattccttgaccccttacgcttcctaggtgaggcgatgcctcaccctgctttggctcacactcgatgggctgcacccgctctccggcacccactgtccgacaagccccagtgagatgaacccggtacctaagttggaaatacagaaatcacctgtcttctgcattgctcatgctgggagctgtagactggagctgttcctattaggccatcttggaaccgcctctcccacattttctttatctgttcatctgttgatggacgtttatgttgcttccatatcttggctattgtgaataatgctgcagggaccatggaagtgctgatgtctttcttgacgtaaaatttcatttccttatacactctgagatgggattcttggatcatgtggtagttgatattttcagttttttggggaattttagtaatggctgtattaatttatattcctaccagcagtatacaagggttctgtttttgtcacatcctcatcaacacttactttgttttgtcattttgataatggccattgtggcctggcacagtggttcacgcctgtaatcctagcactttgagaggttgaagcaagaggattgcttgagcccagaagtttgagaccagcttgggcaacatagtgagaccttgtctctgtaaaaaataaaacaaaaattagccatgtgtgttgatatacagccattgtcccagatacttaagagactgaggtgggagaatcgcttgagcctgggaggtcaaggctagaatgattcatgaatgcaccactacactccagcctgggtgacagcaaaaaagccattcaggtgtgaggtgatatcttattgtggtttttatttgcattttcttgatgattagtgatgttgagcatttttcatacagctgttgtccatttatgtgtcttcttttgaggaatgtctattcaagtcctttgcctatttttttaatcaggttgtgtttttagaactttctttcatttagtttccttacgtattttgggtattaaccccttatccgaggtatggtttgtaaacatttttttcctatctataggctgtctctttatattatgggaatttttaaacatatacacaaaagaataataatcagggactctctaagttcctaattcctagcttcaagagaacattttctttttttttttttttaaagagagtataaattagtatttccttagtattagatatctaggaagttctctctattgtctcatgaactttttttttaatagttggtttgttcaaataagggtccactcattacacacataagcttaataagccttctagtctggaagattccaccttcttttttccttttccttttactgcctatccacattctggatgttactaattgtatcaagtgtcatttagtgtcttctcccggcccctgtgtttgctataaactggatttagttctggtggcctgatcagaaccaggtttgaattcttggcaaggatccttccttctgcatcctgtcggaaggcatgtgatgtccagttgtcccttcataatgcgatcgatcaggtgccagaggtgctggggttttgtttattattattattattattattattattattattattatttaactgcacaagtaatatatattgttcctttacccccccaaaaaaacaacaataatagactgccaaatttttggaccttttctgcatttagaggtagttgaaatcacaagggaaagtggtggtctctaggtcagggatcccccacccctgtggcttgttaggaaccgggctgcacagaagaaggtgagccgtggggcgagagcgagcattaccacctgagctccccatcctgtcagatcagcagcagcattagagtctcataggagcaggaacccaattgtgaactgcacgtggaagggatctgtgttgtgcactccttatgaaaatctaactaatgcctgatgatctgaggtggaagagtttcatcctgaaaccatcccctctgaccctctctgtggaaaaattatcttccatgaaatcagtccccggtgccaaaaagattaggggcagctgtactagggccaccccctcccctattcctggtagaaataattgcctctcagaatgctctgggtgaagacaggagcctcctgggctggatggagagtggagagtagcgcagagttaaatcatttggggatccttccacaatcccccatccaatcaccctgcctaccacctcagtccatgctgctcctcccatcagttatctctgagcttactgtactcacagcctgctcctagagcttctgctatgggagagagggttgtccagtccaggccactgtggcttctgcctttcagggattcattataatttccagtctatcagaagcattcttggttgtttcctgatggaatgaaactgttttgaaattgcccattctgtaggtcagaaatggttgaatatcagcagtttcatgtggttcaacctaataaataatggggttagactaaaatggttacatatttctcaccccaagttatgtccttataatgtatttatacctgacattatatatttgtgacctgtttccctctaagccatgtgagatcaaagtcactttctgcccagtttgcaccatatcaccaacacccacaacagttcctggcccatctttgctctgtcagtaatttttgagggcttgaacatagtcatttgaatagagagataggctggagtttgtgttttggagacatcttgatcaaaatctcaatggctgtcaacgtccatgtgtttggaggtaatagtttaagaaaatgattataatatgattgctaaatagagtggaatacaaaactccatattcaggatgatccagatgtataaagtattacagatgatactgtaaagtctgaattgggcactgagccttgggttaatctgttacttaaacagtatgactatacgctgttgcatttcccagatcttttactcacatgtcttaaatgtagatgtttcacatactggctctttcaagaaagcagttgggtcagaagatggagactagaaagaaaacaggtattgccatcagatctggtttcattctatcttagccaggtaaccttaagatcttctactatttttctgtttatgagacatatggataacctgccctcttaatgtttccttggaagttcaaagtctctaataagtgccttttgtgggatcttgcatgtgttaaccttctcagtaactgagtgccattattgagagtgtgtgcatactggctggagggtccactagttgacactactttacaacaacaggaggaaagaatctgttaaaagaaggatccctggcagggtgcagtggctcacgcctgtaatcccaacattttgggaggctgaggcaggcagatcacctgaggtcaggagttcgagaccagcctggtcaacatggtgaaaccccgtctttactaaaaatacaaaaaaaaagtagccaggtgtggtgagcacctgtaatcccagctactcggaaggctgaggcaggagaattgcttgaacccaggaggcagaggttacagtgaaccgagattgctccattgcactccagcctaggcaacaagagtgaaactccatctcaaaaaaaaagaaggatccctaagagaatataatttagcatgaaatctcaatttttacattgattacttatttggggtgataacgttttgaatatattaggttagacaagattttaaagttaattttacctgtttctcttttactttttcagtgaccactagaaattttaaaactatgtaggtggctaacatcatattgctgttggatgcatcttttaagtgctgctgcctttgattgagctgagtgggttccagttaaccaggcttgagcacatatatcattcattatgtgtttgaacatctcatagcagaagatgccttgcatatatatcattcattatgtgtttgaacatctcatagcagaagatgccttgtggttaatgccctctatgtgttttactgatagcacatttcttagtaaagtgaatcttggtgtattgagacgggcatctcctacctccacttgctgatggcatcagatacaaataggctgtgccatttttagcctggggtttcccagagtcatacccacagccccaacttgtttaacaggattgtaacatcctgtaaagccaccccgtggattatagaattccagggcagctggggcaggagcattgaatcaggaggtttcatcttgactctgtttggccctgtgcaaatcactttacccactacacgttggttctttcttcccaatggagggctgaattgcaccatctctctctctcattcttttgttgttttttttttttgtttgtttgtttttttgagacagtcccactctgttgcccaggctagactgcagtaatgcaatctcggctcactgcaagtgtgagccactgtgcctggccaggctccttttccctacactgcccgtgtattctctccagggacttacctagaaccacacacattggcctattgccgtaagtttgtcagcacgttgtctcagaaaaaaaaaaaaatcctcatcctaaagtgttcttcaaaggctagcgagattgtttaataatacggctattcttattttatagatggccaagctaaagcacatcattttcttttccttcagtgccagcatgagcagggcggggggaccaacctcagatttaagaaagacatgtggctgatttttagggttgtttttagaaacattagatttcttctctaataatgaaatatacttttgaaggactctgacaatgctggaagctcttttaagaaaaatgtcattcttatctgaaaatctttttttttcttctctctctcatgctacattacagctgatgaagttaaaaagcctgggcataagaaaaggggagccctgggtgtgactgccctggaaaaagaggtagagagtgcagtgggttcaagtatgtttgggtatgtgcagtcagtctttgtgtctttctcattcaagtaaattccatagcaattaaagtgaaaataatcatctttcatttgtgagtagagcatccatagaaagcaacatatatcttggtctagaacttaaattccaaaagaatgtgttatatttttcattttcccgtttttgttgcacagggacgagtttcctgatgcttccttgccataggccctgggctctgtgtgtagtgttcttcccaaaccaaaaattaaaaataggaaaatcagaatctataccaagaactttgtctaggaggcttgtctgcagtaggtttcttcagtgcctatgcctcctgctggattgtgtttgattaatccatttcttttaacttgtacaaggtccccattgttagagccacaagtcatttggccactgagggtaaaagatggttaggagtgggatttgttccacttctttgcagcgattaaacagtcagtttgaactggggaaagtatttgacctttagtctgtcctaaaagaatgtcatcaggctgtttatacattaaaaggctctcataagatatgtactcccagattcataattttggaacttctctcctatggtacacacccttgtatgtatgcacacctggctctcactgagtcacttatgggaaactgaagcaagtttttctattaataggggaaaaaagacctcataaaagagtcaaagtaaatgagacttagagaaatgtagaagcatgactatgcatcactgggcctttgcttagtttttattcatcagccatggagaagaaaggcatgactctttcctgcctcccacacccaccggacttgtaaagctcgacttcgatgatgcattataaagtggtgcacaggattggtttttaatgagatttttgccattggagcaaagcaagactgtttccctgccagctgctttattcaagtcatgaggcattttgttgtctcctcctgtacttgtggtacatgggccctccattttctagcccagttcttgttagatacctttgcacattcatttgtatgtatggcagaactgatgatatggcctttctttcacccccaactactaactgtccatgccattaaagatacatggacaggggattccagcaatttctacagttgctcttctttctctttaccattaatcctgatgattgtaggaaatcagtacaccatatttattatgcaaatctaagaaaaacaactagatctataaactatttgaaaagatgcccacattgtatttttttgttgtttttttagataggatctttctctgttgcccggggtagagtgcagtggcctgatcgcagctcactgtagcctctacctcctgggcttaagcaatcctcagcccgtctagtagctaggattacaggaatctgccactgtgcttggtaattttttttttttaaggagatggggtctcactatgttgcccaggctggtttcaaactcctggcctcaagcagtcttcctgctttggcctccccaaagtgctgggattataggcatgagccactgcacccagctacatattttttagaaaaggatcagatgagtaggacttgctcaactgctatcactgtcagaaatatctcaaggtgaaacttgcaaacatatcagtaaggagaaggatgagatttcttttttaatagtcttctttatcaggaatgttttgcagatattgattttttttttttttacaatgagaaaaatatgaccaaaaactgaatattaaaggaagcagagtgtgattcccggtgctaaacagtttctataaaatgtggctaataacatattggcctgttgtgcctaaggcctgtgtttgggttatgccttctcaaagaatgcagtggaagaatctcagcttagaagtgaggacatccagaattctttcctggctgtgccgtgaaattcctttgtcacttagtgtcctcatctgctaaatgagggtgttgaattgattcctaaaagttctggtatcctcccctcttcagattatttcttcaacttattttcttggtagaactgggagaggttcgactttgcttttgtcacgcattcttactcatcaggaaagtcccgctataaacacagtgctgagggatcagttatgtcagtctgtttccttctcccagagaccagccctgccttgggcttcccctagaactttatgtcatagcataaaggcccgtgtctgggccctgaggttgggagtatgctctgatgtcaagtatttgatcattctctttctgcctcttgatgactagaaagcgttttatggtaaagagttacgcaagaagcctttgtttagctctttctctcattgctaaaaatagtaagctgtttttaacccttactgttcttacttcttcttactcatttccctcactctttagctgagaatgtcacctccacctttatagagaagacagaaacttaagcataaactcttcaccttccttcaccttccctttccccagttacttgcgtccctgttctttgtcatcctcttgtctgtagctgtccttgaagtggtgtccactattcccctggatgaggttcattcttacgttctgttccataacctagttgtgttattaacttcccatcatacatccttttattaaaaatcctacactaccagtttttgagttcctattaggtgtcacaatcagttaatcccacttacggcatacagcagtcattattccagtttatacttgaagaaacttaggcccttactatgtttctggcactgcttattatcacagctctagaagacatcttctatctaccttatccttcccttttacaaaaggtgagaaaactgaggcccaaagaggttgttgtcaccacctatgtagagtgaggatttttatttttgtgctattgtttagcatgatctcatgaaatataatagaaaataaggggaaactatggtacctgtttattgagcagccttccttgactgggatataaacatccattggttttcctcctttttcatgccaccacaagcactcaggggcactcttgataccagaacagtgggaggatcttagtgatattggtccaaattcataagttttcacttctcttttttttgagacaagatctcactctcgcccaagctggagtacagtggcgccacagctcactgcagcctttacctcccaggctcaggtgatcttgccacctcagccccccaagtagctgggactacaagggtgtgacaccatacccagctaattttttgtatgtttttgtagagacagggtttcactatgttgcctgggctgatcttgaacatctaaactcaagggttccacccaccttggcctcctaaagtgctgggattacatgtgtgagcctcacttccttctggttatagagacagaattgttccacttcttagtctgatgtttctgtcagaattttttctcatgactgcctattcacgctgctgtttgattcttgggatatattttaaatgatgggtagattcacttcccctaaaccgtcctccttatgagcagccgttattctgctctgccagtaaattaattgactcacgattctgcatgttggggcttgttgtggatacagaccgtattctgaaatgtcctcagaggtcgatgattgtgtttgcttctgccaggggatgggtgtttgccctcagcttgtttgcaacaccacatttcctcaaaggaaacgtattaactaacagctatcttcaagccaatgtaagagtcttgattcaagaaacaacctaccagtcagtctatttctaggcttttctccctctctttgaaagtgccagtgttcttcctttcactctcttgaactcatttttcctgccagcacacatcattttgtctcctttacttttccataggctgtttttttttatttgtctactagcttttcttatcacatatccctgcttgacaaccttaagcaatttgttggatacccttgatttgaggcccatcaatatgtcatactttgggattggcagaagaaatgtttagaagcatattttccataaatgatagtgacaagtgccaagcacttgcttcatgttgtctcattcagttttcacggggactttataaggtaagtgggattactcccgtttaaggaaactgatataactgaggtgcagagagacgagagtgactttcccagaggcacacagctagtgagtggtaaagccagtagataagccagtccctgaaatccgtgttttccagtaggatcccaagctatggggagataaaaattagtccccttgcctagctagagggctttaaaggttaaagcaagaggaagaagcagaccttatcttttagttctgtaagtttggagtgtatcgtgggtctcactgaaactagaaaaattgtcagcacggctgcattcctttctggaggcttagggtagaatccctttccctgcctttgccactcaccttggcatatggccctcatccatcttcagagccagcaatggcaatggagtcctcacctctcatcatgctgacattgactcttctgcctccgtcttccacatgtgaggactcatgtgaagacatgccgcacacctagttaatccagaataacctttctattttaaagtcagcttgttagcaaccttaattccatttgctctcttagttcccctttgccatctaaagtaatatattcataggttctaagggttagcatgtggacatcttcggaggggccattatttgaaatctaaaatggagatgttattgcatcgcagtctattgggaggtagccactggaggtttttgcagccttgtttttatatttaagcaagggtgtatatgtgtgtcttagtctgttcaggttgatacaacggaataccatagactgggtagcttctaagcaacagaaatttctcacagtcctggaggctgggaagtccaaaaaaagttgccagcagatttggtgtctggtgagaacctactttctcacagatagcaccttcttattgtgtccttacatggtggtagaagggcgacctagctctctgggatctcttttataaggggtctgatcccaatcatgagagatctgcctaatcacctccaaaaggctccatctcctaataccatcacatcttgtgagtttggatttcagcataggaattttgggaggacacaaaacttcagaccatagcagtagggatgttgctaatacctcacgaagaaagaacttaaagaagctgagtaatttgcccaagaccacacaaaaattcattcgaatccagggacaaaactatatttcctgtgttttctccatgtcactcagaaaattcagcatgagggagaaatatgattcttaatatagaatcatatttctatattgaaatatgatttcaatatagctgttttggctagaacttggaagtgaacaggcaggcttaattgggcaacagtccccactttgtggggtgtgatcggcaggcttattccaggcttcttgctgagttataaaacttctgatttatctgatagagaccttcagaaggaggactggtgctattaaaattatacacatttcattctggaatttcttttgagggcatcatccactcccctcagctgtgattgtaaacctcattgctcttggtcagaatttcattcagcattaacaatgacacatcctgttatgctgtgcaggtgtattgctgtttataggaatttaagtttagatcattaaatgtttcaatactgaatgtattgacagttaagttgatgacgcagaaaactacaaatagctgggcaaactataagaggtgtttctcgtctgcaccttcccttctggtatcttgatagtatagcccaaaaatggttttaagcccttgcttctcccccagggctaccctctttgcttgcaccttacaaggttgagtgttgtgaggccccatctggtgccgactccaattctgtctctagcccagacccacacttgtgagctgctatgagttatctgggcatcttggttgacttaatcttcctaacatccttgtaaataggtggatgaatactatgttttatgattggaaaatgaagaatcaaaaagatatggcaatttggtttaagtccacatagctagtagttagggagctttgttgagaaagaaaaatgcatgagaggaaattaagactgtagttaataattatcaggtgcatattaacgttgcatgaagcttaacttaaatacatgttattcttaaggttaaaaagttcaaaacaaaggcgggggttccaaggcaaatgggtggggatagacaggagatgggcagaggtagatgaaatgcgggtgttatggtgtggaagtcagttggagtatagccactggaggcttttgtggccctgttcatatcatagttataagtgggatgttgctaatgcttgactcatcaaaggctgaaacaaagccagagctgaagttgagtacgtgtcaccgttttattggttaatctttcaaaaagagaaaagcctctgtttatacaggctgaaacagtcatttgacctgttcttcaactccatctggaattgctttggggttaacttagcatttcccctaaagcgcatatgacagtgggttgggaggagctcggatggggtttttgttcctccagagcgctgaggccttatttctgagtgaggtggccttggtgccagctaatgccactgtttagtgtgtgatgaactagaagtaacaggttaattttggccagtagacttgccagctgtgtaaacggaaccagtgaaactatttctcagtgctgcctcccacccctggaagaggacatcatgttatctacctgcccctgttggcttcccttgacccatctctcccatgctgtcccctcctccctgtgttactcatcagttcaaatttagaataattgaatgcacagagaaagtggcttgttctgaaaacttctgacaagaaatttccaggtgacttggtgctagattaattttagcctctcttatggattcaaaactgttttgtcagaagacttgaactaagacactttagaattaattacggctgggaaaaagaacaatctaaatgaggcagcgaacaaagattcctaaatatggagcaagacaagtggctctttatttcagtgggtcactggcatgaaaaaatatagttggggttacaggcaggaattactcttagagacatgggaattaaatgcaaggtaagtaccttgtttggaccctgaaactaacaaagcaactgtttaaaaacaaatttttttaagacattggggaaatttgcatctgctctgagtcaaagcctgggatttgtgtttgtgaaaaagctaatagaggaagcaagttggacacaatttaagaaattgttgaatctgggtgatgtgtatatggtgttaagtatatgattttccacgtctgtgatgatgaaacatttttgtattgacttcttaagtgtcttacctggcctttctgagcccacagttgagttgcacctgcaatccaaagtggttaccccgtcacggctgccagaccacagacactttaattcttgttgtgcggtgtgttgctgccagcccagagccaaaaaagcggaataccaccctgaagcttttgtaaacaattgtctttagcttatccagaggaattgagtctggagtaaagacccaaatattgacctagataaagttgactcaccagccctcggaggatggaaagatggccttaaaataaaacaaacaaaaaccttttttgctttattttgtaggaccactatgagacctcagtccttctatgatggaagtcattcttgtgccagaggagtgtgccatattccaatggctgagccgttttgccccaaaacgagagaggtgtgtagtctttctggaaggtgtaccagaataaatcatgtgggcttggggtggcatctggcatttggttaattggcagagcgagtggccccataccctcactcaagtttgctttgtattatgcaaagttttatgaagagttatttcctgttgctaataatttcctgttcctctgttactctcagtcattttaagctgaaccactcaaagttgcaacctacctttttaataagttttgattttgctatctagataaaatgatttaacatagaatatcacattactcaagagtatgcagtctggagccagattacttaggatcaaatctctgctcttcaacaaagtagctgtgtccaagaggacaaattatttgacatatgtgggtttcagttatcttacttctaaaatgaagataattatagcatgtaccttataagactgtgtgagggatgagagagttaatacttaatgaagtctctgaaccatgcctgtcagttatggaacatccaatggctggtaactgcttttgtgaattaaattactattattgatcttctaaaaatggtcagattggcagctgttgcctttgacctgagtttggccattactgcccagccttctgtctaccattatagccaaatcacagaactatggggacagccccacaagggccagtggtggtataaggggtggaatcacagttttagttcccaagcaacaaaaatggctaccatgactaagaagcctatggcttggtccacatgtgctacttctcttataatcccaggtttgaaagtcaggtgcaactcaaaagatcagaagtatcgttagagattaactgcttcataaaatctcccttatgagttaacttagagaatataaatacctaaacacgttagttattcagataatgttaacacctgcatatagagagtagatgatttcttttagcatttatgttttatcctacataatcacagaaaacccatttccttatagttaacagcaagggcacctaaactgaggacacagggttgggagaaatatttctagtctcaaacaagaatttggaatctaaaaccgagtactgagggaagccatttcggagataccactgcgcattgattttctctgacttctaggaaagtacgtcttttacttggtttttttttttttttaaaaaagtggcaggcgaagtttgtatatgtatgtatagcatgtttctggatagttatccacagaatgtatcagaatgctgctagtcttcctctgaagcacagatctgtccacataatagatttgctatcctgggggaaatgaagtatggataaaattcttgtccacttcaaaatgggggcagcttgggaagaaatagtctaaggagagaatatgcatgctcgtatgaatctgaggtcagttctcaggcaaaatacagtgacttggggaactaggagtagaggtagatggggaaagcacaatggagctgtatagagcacatgtaaatgtgggtctgtggtgataatttccagtaatccaagttagcctcccttgaagccaaattaattcagcttcataaagactgagagaatactgggaaaggcaatttaagaaaatggcaaaataagcattcagaaagaaatttttaaatattatccaaaaacatgaagagtaaatagtgctgccacttggtaattttcacttttaacatccacatgatctttcatgtactgatggaataggactgtcatgatgaattgtcaagtggcaagcaagatactcagtggttgtaccatattctaccatttatgttaaagtatgtatatatacaaagaagtaagtatgtaaatatttatatacaaataaaatatttttggaaagttaacaaaaaaagctggtaacaggaaacagggaagatggcagataagagacagggctggccaccacggtggctcacgcctgtaatcccagcactttggaaggccaaggcaggcggatcatgaggtcaggagatcaagaacattctggctaacatggtgaaaccctgtctctactaaaaatacgaaaagttagccaggcatggtggcaggcacctatagtcccagctacttgggaggctgaggcaggagaatcgcttgaacctgggaggcagagcttgcagtgagccaagattgtgccactgcactccagcctgggtgacagagactccatgtcaaaaaaaaaaaaaagtaaagaaaagacagggctaacgtgcagcttccacaaggacggacagaatagcatatggagacactatgatcttttgttccaagaaccactgtaggaacttaccgggaaaaccaaaagaattcaaagatcctttgaaagaagtggcacaccactgcaaattctgcaaaacaggcaagaaactgagttcccaaagtgtgagtcggggagaacctacctctgaatacacatccccactggggaaatctaaaaatccagatcatggaggaagaatttaaccttacctagaggtgaaacggatttagggggttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggcagggcgaaggaagctcccaaatgaaatcagtagtggtttcagctggtcacaaattttctcaggcagagtccaagggactaatgggagccgcagcagatacaagtgagtacaggagctgctgctgatggagtgggcaggtgggaaggggtgaggtccaaaggccatgcttgctttcccagtggggtagctcacagcctggggcaaggtctgagcagggcactgcaggagtgagactagcctcaccaactgcatagtagctggatgaggcctcttgctgctggctctcccccactaccctggtaaagtttatgatacagcagaggcagtcaagatctcctctggaacataaacccagtggcctgacaaaccacccccatcccccaatttcccacagtgtctgcagcaagccctgcccaagaagagtctgagcccagaaccacctaaccctgccccaacctgatggtatttccctacccaccctggtagccaaacacaaaatatttattgccctgcctattgcctgggaaaccaaaatagttaccttgggcatcttagggcaagcttagagccccctactccttctgcagctggtgctctcttgaaagtgccacctcctggctggaggccagtcaactgaggccattacagcaactcataaaacaataaccctgatcccaggacggaaaagacaacacctaatttcactgcctgcaacatcctggctaaccagagatcctgaatatgtccacatgacaacttcactgctagcataagcagcattcaagagagccagcacattaaacatatctacaaccaatgactcttgcagagtttacttcacttccctgccacatctaccagagcaggtgctagtagccacagcttggagacctgaagatggatcacatcgcagtactcattgcagacatcccccagcaacagcccagagcctggtggcctcaatgggtggctagacccagaagagcaataacagtcactgcagtccagctctcaggaagccccatccctaggggaaaggggagagcaccacatcaagggatcaccccatgagacaagaaaatctgaacagcaggccttgagtttcaacctctccactaaaatagtctaccaaaatgacaaggaaccagaaaagcaattctggtaatatgacaaaatggggttctgtaacacccccaaaagatcacaccagctccctagcaatggatccaaaccaagaggaaatctctgaattgccagataaggaattcagaagattggttattaagctactcaaggaaatagcagagaaaggtaaaaaccagcataaagaaattttaaaaaacaatacaggatatggatgaaaacttctgcagagaaatatcataaagaaaaaataaatcacagcttcaggaaatgaaagacacacttagagaaatacaaaatgtagtggaaagcttcaacaataggctagaacaagtagaagaaagaacttcagagcttgaagacaaggctcttgaattaactgaatcaagacaaagaaaaagaattttaaaatgaaattttaaaagaaatttgggtttatgttaaatggccaaacctaagaataattggtgttcctgcagaagaagagaaatctgaaagtttggaaaacttatttgaggaaaactttgctggccttgctacagatctagacatccaaatacaagaagctcaaagaacacctgggaaatttattgcaaaaagatgatcagctaggcacatatttatcaggctatctaaagtcaagatgaaagaatcttaagaactgtgagacaaaaacatcagataacctataaaggaaaacctatcagattaatagcagacttctcagcagaaatcttacaagccagaagccagaagggattggagtcccatttttaacctcttgaaacaaaattattctcagccaagaattttgtatccagtaaaactaagcttcataattgaaggagagatagtctttttcagacaaacaaatgctgagagaatttgccactattgagccaacactacaagaaatgcttaaaggagttctaaatcttgaaacaaaacctcaaaatacaccaaaatagaacctcattaaagcgtaaatctcacaagacctataaaacaataatacaatggtgaaagaacaacgtctttaggcaaaagctagcatgatgaatagaacagtacctcacatcccaatactgatgtcgaatgtaaatgacctaaatgccccacttaagaaaagatacgcaatggcagaatggataaaaatctaccaactaagtatctgcagtcttcaggagaatcacctagcacacatgaactcacaaaaacttaaggtaaaagggtggaaaaagatattccatgcaaatggaaaccaaaagcaattaggaggagctagttttatatcagaaaagaacagactttaaaacaacaacagttaaagcaaagagggacattatataatgataaaaggagtagtccaacaggaaagtatcacatttctaaatatatatgcacttaacacttgagctcccaaatatatcaaacaattactaataggcctaagaaatgacatagatggtaacacaataatagtggggcacttaagtactccactgacggcactagacaggtcctcaagacagaaagtcaacaaggaaacaatggacttaaactataacctagaacaaatggacttaacaaatatatatacccaacaactgcagaatatacattcttttcatcagcacatggaacattctccaaaatagaacatatgccacaaaacaagtctcaacaaatttgaaaatcaaaattatatcaagtactctctcagatcaaagtggaataaaattggaaattaactccaagaagaatcctcaaaactatacaaatacttggaaatgaaataatctgctcctgaatgatctttaggtcaacagtaaagtcaagatggaaattaaaatattctttgagctgaatgattatagtgacacaacttatcaaaacctctgggatacagaaaaagtggtgctaatgggaaagttcatagcattaaattcctacatcaaaaagtctgaaggaggacaaatcaacaatctaaggtcacacttcaaggaactagaaaaacaagaacaaagcaaacccaaacctagcagaagaaaagaaacagcagagatcagagcagaactaaatgaaattgaaacaaaaaaatacaaaagataaatgaaacaaaaatatttgaaaatttaaaattgatagaccattagtgaaattaaccaagaagagaaaagatccaaataagctcaatgagaaatgaaacaggagatattacaaccaataccacagaatacaaaagactattcaaggctactatgaacacctttatgcacacaaactagaaaatctagaggagatgagtaaattcttggaaatataccaccctccccaattaaatcaggaagaaatggaaaccctaaacagaccaataacaagtaggaagattgaaacagtaattttaaaaaattgccaacaaagaaaacatccaagaccagagggattcacagctgaattctatcagacattcaaagaactggtaccaatcttactgaaactattccaaaagacagagaaagcaggaatccttcctaattcattctgtgaagccagtatccccctaattacaaaatcagaaaagaacataataaaaaaagacaactacagaccaatatccctgatgtacgtagatgcaaaaatcctcaacaaattactagctaaccaaatccaacagcatatgaaaaagataatacaccatggtcaagtgggtttcataccagtgatgaagggatggtttaacataggcaagtcaataaatgtgatacatcacataaacataatttaaaacaaaaatcacatggtcatctcaatagatgcagaaaaagcatttgacacaatcctccatctagttataattaaaaccctcagcaaaattggcatagaagggacgtacctcaaggtaataaaagccatctatgggctgggcacggtggctcacacctgtaatcccagcactttgggaggccaaggcgggcggatcacaaggtcagatcgagaccatcctggctaacacggtgaaaccccatctctactaaaaatacaaaaaaattagccgggcatggtagcgggcgcctgtagtcccagctactcgggaggccgaggcagtgaatggcgtgaacccgggaggtggagcttgcagtgagctgagatcacgccactgcactccagcctgggcaacagagcgagactccgtctcaaaaaaaaaaaaaaagccatctatgacaaacccacagccagtgttatattgaacagggaaaagttgaaagcattccctctgagaactgaaacaagacaagattcccactttcaccacttctgttcaacataatacaggatgtcctagccagagcaatcagacaagagaaagaaataaagggtaaaaaatcagtaaagaggaagtcaaactgttgctgttcaccaatgatatgatcgtatacctagaaaaccctaaagactcatccaaaaagctcctagataaatgaattcagcaaagtttcaagatgcaaaatcaatatactcaaatcaatagcacttttatagaccaacagcaaccaagctgagaatcaaatcaagaactcaacctgctttacaacagttgcaggaaaaaaaaagtaaaatgcctaaccaaggacatgaaagatctctacaaggagaactacagaacactgctgaaagaaattatagataatacaaaaaaatggaaacataccatgctcagggatgggcagaattaatattgttaagaattcttacaaaagcaatctgccaaaaagcaatccacaaattcaatgcagtttccttcagagtaccaccatcattcttcacagaaatataaaagtatcatatttctgccaaaagcaatccacaaattcaatgcagtttccttcagaataccaccatcattgttcacagaaatataaaaaaaaaaatcctaaaatttatgtgagaccaaaaaaagagcccatatagccaaagcaagactaagcaaaaagaacaatctggaggtatcacattacctgacatcaaactatactacaaggctatagttatcaaaacagcatggtactggtataaaagtaggcatgcagaccagtggaacagaatagagtatccagaaataaagccaaatatttacagccaactgatctttgaaaaagcaaaacaaaaacatacactgaggaaaggacaccctatttaacaaatgttgcaggataattggcaagccagatgtagaagaatgaaactggatcttcatctctcatataaaaatcaatgcaagatgcatcaaagacttaaatctaagacctgaaaccataaaaattctagaaaataacatcggaaaaacctatctaggccttggcttaggcaaagagttcatgatcaacaacccaaaagcaaatgcaacaaaaactaagacaaatagatgcagcttaattcatctaaaatgcttcagcacaacaacaaaaaataataatcagtggaataaatgaccacccgcagaaagggagaaaatattcgcaaactatgcattcaatagaggaccaatatccagaatctacagggaactgaaacaaatcagcaagaaaaaaaaaaaaggtcgctaagtacatgaatagacaattttcaaaacacatggccaacacacatgaaaaaatgctcaaaattactaatccaggaaatgcaaattaaaaccacaatgcgataccaccttactcctgcaagaatggccataatttaaacatcaaaaaataatagatattggtgtagatgtggtgtaaagggaacacttttacactgctggtgtgaatgtaaactagtacaatggaaagccatatagagattccttacagaactaaaagtagaactaccatgtgatccagcaatcccactcctatgcgtctacccagaggaaaataagtcattatatgaaaaagacacttgcacatgcatgtttatagcagcacaacttacaattgtaaaaactatggaaccaacctaaatgcccgttgaccaatgagtgaataaagaaaatatggtatatatacagcatgggtgtgatggttaatactgagtgtaaacttgattggattgaaggatacagagtattgatcctgggtgtgtctgtgagggtgttgccaaaggagattaacattgagtcagtgggctgggaaaggcagacccacccttaatgtgggtgggcacagtctaatcagctgccagcatggctagaatataagcaggcagaaaaatgtgaaaagagagactggcctagcctcccagcgtacatctttctcccgtgctggatacttcctgccctcaaacatcagactgcaagttcttcatttttggaactctgactggctctccttgctcctcagcctgcagacggcctattgtgggaccttgtgataatgtgagttaatacttaataaactcccatttatctatctgtcccattagttctgtccctctagagaaccctgactaatacagattttggtaccaggagtggttctagaggaacagaatattaaggatggagttcttttattggtatgaggtttctggagttgactgcttaatatgattagacccaaagatgctaaggactctacttctaataatatggataacaccaatagtccttgacttgaactgtttagagagttatgcaaaataaatatatttgagactcctgattcatcactcgtgagaggcaaggactctacataatacctttgaccatatgtggaatcacccttagtgactctgtacataatacctttgaccatatatggaggaccagggaacataatgaagctggttggttgctcctaagttcagtggacaaagtgatgaaagaaaataatgaactcagggattgtatctcccagctccagcagcagatactgagcctcagatctgctaagattgttctgaatgaaagacttatctcctgtagagaaagagctgaaattgtggaaaaacagacacaagctcttatcatgtgagtggctgacctgcaatgaaaggtacatgcacagcctcgccaggtgtctactgttaaagtgagagcattgattgaaaataaatgggaccctgcaacttggaactgggatgtgtgggaggaccctgatgaagctggggacactgagtttgaaaactctgatgaaccttatttaccagaagaaacagctttcccatccccagaagtggcagcatcccctccctgacctatgctgccatcagccttttcacctttgtctgaggagataaaccctgtgcggcctgaggcaacagtgatggcctcccctgaggcagttgccaggcaagataatgttgattcttctcaggagccacccctaagactcccatttgcttctagacctataactggactgaagttccagcaggcccctagaggtgaggttgagattgtgacccatgaggtggtgtgctacactcaaaaagaaccgcttgagttttctgatttatataaacagaaatctggagaacaggcatgggaatggatactaagggtgtgggataatggtggaaggaaaatggagttggatcaggctgaatttattgatttgggcccactaagtagggattctgcatttaatgttgcagctctgggagttaaaaaaggttctaattatttacttgcttggtttgctgaaatatggattaaaaggtggcccactgtgaacaagctggaaatgcctgatctcccttggtttaatttagaggaggggatccaaaggcttatggaaattcagatggtggagtagattagtcactttagacctatttatccctgctggtccagaaaatatgcccttgaccaatgccttgcaaaacagatatgtgagggcagcactgggatctttgaagagccctgtaattgctcttctctgtatgtcagatctaactgtggtaatgtcagatctaactgtgggaaccgcagtcactcaactacaaaacttaaatacagtgggaataattggattccaaggcagcaggggccatggcggcactcagctgtcaaaggcaaggtgggcatagctaccataatgggcagcagaggcaaagcggcaatcagaacagtctgactcgtgtaaagctctggcactggctaattaatcacagcattcctagaagtaaaattcataggaggcctactgcattcctacttaatttacataagcagaaacttctaggtcaaatggacaaaaaactaatttgaattataaaaacagactcacagcccctcaaccaatttccagacttgagctagtttacagacccagaaccccttgaatgaaggggaggccaggtcccgttgaggaaggaccccactatattaccaacaatttatgctgtgaatctttctcccgtccttccccaaggagacctccgaccttttaccagggtaactgtgcactggggaaagggaaataatcagacatttcagggactactggacactggctctgagctgatgttgattccagggaacccaaactgtcatgtggtcctccagttaaagtaggggcttatgaaagtcaggtaattaatggagttttagctcaggtctgacgtgcagtgggtcttatgggtgcctggactcatcctgtggtcatttccccagtgccagaatgcataactggcatagacatacttagcagctggcagaacccccacactggctccctgactggtaaagtgatggctattacagtgggaaaggccagatggaagccattcgagctgcctctacctagaaaaatagtaaagcaaaaacaataccacatccctggagggattgcagagattagtaccaccattaaagacttgaaagacgcagggatggtgattcctaccacatccccatttatctctcccatttggcccatacagaagacagatgggtcttggggagaatgacagtggattacaataagctgaaccaagtggtgactccaattgcagctgttgtaccagatgtgatttcattgcttgagcaaattaacacatctcctggtacctggtatgcagccattgacttggaaaatgcctttttctctatatctgtccataaggaccaccagaagcaatttgccttcagctggcaaggccagcagtataccttgactgtcctacctcaagggtatatcaactcttcagttttgtgtcataatcttattcagagagaacttgatcgctttttgctcccacaagatatcacaatggtccattacattgatgacagtacgctgattggatccagtgagcaagaagtggcaaacacaccagacttattggtgaggcatttgcatgccagaggatgagaaataaatctgactaaaattcagggaccttctacctcagtaaaatttctagggggtccagtggtgtggggcctgtggagatactccttctaaggtgaaggataagttgctgcatttgtcctctcctgcaaccaagaaagaggcacaatgcctagtgagcctatttggattttggaggcaacacattcttcatttgagtgtgttactctggcccatctattgagtgacccaaaagggtgccaattttgagtgggtccagaacaggagaaggctctgcaacagttccaggctgctgtgcaaactgctgtgccatttgggccatatgacccagcaaatccaatggtccttgaggtgtcagtggcagataaggatgctgtttggagcctttggcaggcccccataggtgaattacagtggagccctctaggattttggagcaaggtcctgccatcttctgcagataactattctcctttcgagagactgtccttggcctgttactggactttggtggaaagtgaacttttgactatgggtcatcaagtcaccatgcgacctgaactgcctatcatgaactgggggctttctgactcatctagccataaagtgggttgtgcacagcagcattcagttatcaaatggaaatggtatatatatgactgggctcaagcaggtcctgaaggcactttgctgtgcccgtgcatggcctccatccttgccacctggacactttgggctcctcctgcctttaagtcaacaggctaagaagggagttacagtgctggctggggtgattgacccagactatcaagatgaaatcagtctactactccacaatggaagtaaagaagagtacacatggaatacaggagatccattagggtgtctcttagtattaccatgccctgtaattaaggtcattgggaaactacaacagcccaatccaggcaggactacaaatgacccagactcttcaggaatgaagatttcagtcactccacaaggaaaaaaccacaacctactgaggtccttgataaaggcaaagggaatacagaatgggtagtagaagaaggtagtcatcgataccagctacaaccatgtgaccagctacagaaatgaggactgtaattgtcatgagtatttcctcctccttttgttaaaaacatgtttgtgcatatatacagttgtactaagaaaatatcttcattgtattttctttctcctttatcatatgacatgagatttattgacttcacatcaacatttaagtattgctaactttatgtagtagtatttgggttggtgtttggtgcatttccagttgcacaaaggatagctgtattatgttacgtgtaattatgaccttattattgtctttatttgaagattatgtatgatctcaggagatgtgtatggattcatgtggacttgtgatggttaacactgagtgttaacttgattggattgaaggatacaaagtattgatcctgggtgtgtctgtgagggtgttgccaaaggagattgacatttgagtcagtgggctgggaaaggctgacctagccttaatctgggtgggtacaatctaatcagctgccagcatggctaggatataagcaggcagaaaattgttaaaagagagactagcctagtcccccagtctacatctttctcccatgctggatgcttcctgccctccaacatcaaactccaagttcttcagttttggaacttggactgtctctccttgctcctcagcctgcagatggcccattgtgggaccttgtgatcatgtgagttaatacttaataaactcccctttattagttatgtccctctagagaactctgactaatacaatggaatactacttagccataaaaaagaacaaaatgatggcatttgcagcaacctggatggagttggagaccattattctcagtgaagtaactcgggaatggaaaactaaatatcgttatgtcctcatttgtaagtgggagctaagctatggggatgcaaaggcataagaatgatataatagggccgggcgcagtggctcatgcctataatcccagcactttgggaggccgaggtgggtggatcacaaggtcaggagttcaagaccagcctggccaagatggtgaaaggggtctctactaaaatacaaagaaaagaattagctggccgtggtggcgggtgcctgtaatcccagctaatcaggaggctgagccagagaactgcttgaacccgtgaggcagaggttgcagtgagccaagatcgcactaatgcattccagcgtgggcgacagagtgagactccatctcaaaaaaaaaaaaaaaaatgatgtaatggactttggggcctctgggggaagtgggagaggagaatcagggataaaagactacacattgggtatagtgtacatttcttgggtgacaggtgcatcagaatcccagaaatcactactaaagaacttatatacatcacaataaaccacttgctccccaaaaactattgaaatgaaaaaaaaaaaaaagcctggtaataatggtttcccttgggaagggacagtggttttccttgtactatttaagttttgtaccatgtacaaatacgtgttccaaaagcagtgttacttctattcattttaggagttaatatgaaagtcctgacattaaatctgtttaggctggtgatctaatattgctagttccttggtgagggttgtggtactttcactaccacatccgtctgtttagtagttcagtgattacacgaggtaagaaaatgaaatcatcttaaactcagacctggaccttgaccctgtatttgatattttttgctgccttaagatagtgttagctgttcttgaaggaatgcaaaatgctggttcaggtggctgacatatattcatagcctccatttcttcctcctcctcataagcatggtacctatctcccaaagtgccagagtgacagtgaggacttgtcaagagccattcatctctagaagcactgtgaactttagccaagcatatggttcagttattcaggatctttaaagacattattgaaccagcgggagtgggcttgttatgtcttaactttaggggggaaaagggggtggggtagagatttaggcttttgcatttataacatatactttttagggaaaagtgttaattaagcataattttattttcagcatttataagataaacatgatgtagcatcaactgttcattgtccatagcttgctaaattttgagttgccaagactcttgtgaaaattctgtttcccattgcagtggcatagtgtaagttattttttaaggaaataggttaatttgtttatgtgatgaacacatgtgcaggtgagactttgcccagattggagactttgactttgagtcactccactttatttatatagtatcccaggaaggttagccaaatatgtgtagaagctgccagtattaatgattgttagaagaccagcttagtgcatacagtgtttacagcgcacctggcatgcttctatgcttgtatataccttagttcatttaatcttcctcatacaattgaattatgcgatatcattattctcaatttacacttgagaaaactaaggcatacagagatgatttttcaacagtgcttcagtaagttaacagttaagttgaaaagacttttttttaattaaaagggaatattgaataagctaagaaaaaatgaaggtaattaataacttgaagattagatgtgcagtattaaataaaacactggagaaaaggatcgaacttttcaatgatgtttctaaaaatccatgcctagccttgccactaaaggaattccaagatgtttatccctgtgaacagaaaaacaatcagcacaactctgtggaaaggcaataggcaaaagagaaatcactttctaaccagcaaaagcttttacagaagtcttcagattctgtatttttaaaagtaatgagaattaacttttcagaagcctggaaatagaactcaacacacctgtttgagaagataagcgacgagaggcaccttagcttagcctgcgaggttaaaagttaagactccagtctgtattctcaaaccagcttagtctcttaaagttgttaagaagcaaatgagattaaagcatataaacaaatgcctggcgagtagaaagagctcagtgcttgcttgtgtagctattagtttctacatgcaaagggctggggaaacaggattatgtgaatgagaaagggtccaggaaacacccttctgtggtcctctaggttttttctgagagcctggcagatagtaggcatttattatagtgacaaatcatctttaagaaatcaacttggtaaacattggggggaagtgcagccttaagttgtgcatgtgctagtatgttttgaagtttctggtttttcttttctaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtaggtggaattcttttctaagcacatatagcatgggtttctgggtgccaatagggtgtcttaactgtttgtttctattacgttagtttcagaaagtgcctttctacaaggttttgaagttgttaatattttctgtagttccattggaaggtaagaacaaagatcaaaggaaagaaagagacacttttacccaaggatcagtagtgaaaatagtacattgtaggcaggtagatgtgttgagaatcatactaagacttgggccttattttcaggataaaggtgtattttgattgccaatttctgctgctatgctactgttttttgttttcaagaaggaaaaaaatctattaaccctttcctcatgagagggctgtatgttcacatccatctatttaacgtaccgtggctggatactctgttcagcatagaaatgtgacaacaaacagagaagtccttaaggagccgacattctgtcggatggagatagaagttaagcaaaccaatataagaaagctaacggttataaagaaatagaatggtgaggtacaagggtacactaggtcaactgaatagagttgaccagaccaaatatttgaagtatgagaagccttcctgttttaagtgtgatgggcaagaagggcatgattgagtagagtggaaaggagggagactggggagaagggagagagaggagggatgcaatacagtagggccaggccatacagaccatggtaagggtttcagatggaaggacagtgaggggttcaggcagggaaggcagcaggatccagctggaatttgaggacactggaacaatgaggtcagcttccaaaacaaaacaaaacaaaactttaaacatctgtgtaagtacagggtggaatataatgaattccaggtacccatcacttaggttccacaattagccatggccaatcttgtgtgataggtatgtccctacctatttctcccctgccctcattgtgaagtaaatattttcctaaaaggtctttttaaaattaagttataaccatgccatcattgtacaaaaataatgatattaatttcttaatataatcaaatattcagactattcctttttccttcagtctcataatttttaacaatttgatcaaatcagaatcccttacaatccatatgttgtattttaatgattacctcttgtctcttttaatctaattttcacctctttctctttttattccttgtgttacttgaataaactagatcgttcgtcctgtcatttatctcattttaagataaagggacgacaaaactgcagtcacttttgaagtaaggaaaacatttaggggtgactttctgagcacatttagggtaagtgacatctccaaagaggcctaatattgtaccaccgttttagagagtttgttttactatctaatgtgtacagtgttttgggtcatagatgaacacaggttctttgtttttcatgaattccttatgatgactcttcagtgtaataaactgtttgcttagtactaggatgccttttatgtaagagattcgcaaattattacattaagtcacaacataatatcttatttggcagctttggtaacctaaggaacaactcagcctcgtaatgtcaagaagctgcttccaattaataggaaactccagcccctgccacaccctgagagcggtttgcttcctgcctgtggctttctgctcagtctaataacatatgtctcctcctttgtagaaccagcagtgatttcctttagtagccaaatgaggttggggaaatagtcagctggagctactttattgaaaagcagagaaattaagctctgtaagtggaaaggcttgaagacagtgttaaatgctacaaggaaggcccacagaaagatggcattatttcagccaatcgtgtgttgcagcctggcatggcaaaaaggatttggagttctctaaacccatcttcagatttgagttgctccatttgcttgtcacattgggcgagttatttcacttgtttactcttctgtagaatgaagccagggctctgggtgaggagtggaggttgtttagtcattgtttagtcagttagaccttgaaagattactggaagaattaaaccaaatgagatatgtaaaaaagctagtataatgctggcttgtaagagggtggtcatcagatggtggctctgatggagtggggggcctgagaggtgggtagtatcagggaaaagcatttaaactgcaccttgaagagagggtttattttgggaaggtcagtaggaaggacattttgggtgaagcccaacagctggaacaaagagaagggaggtcagtgtctatacagaaataaccagtcacaggaaaaatatataaggaaatgagtaaatacaaggcaaatttcttggatgcttcatgtctgcattcaaagactcagcttaaaacatatcatttacatgtgcctggcagatacccagcctgtcactgctttgtgttcccatagtagtgcaaactcccctctgctacagtgttcatcattttttcctatacacatcttggtgtttgtgggtgggatctggactatgcttaaggaaatagaaagatgtaatccttgtgtccctgaatgctggatttcttcgaagcataggaaggcatgtcaagtactctatctctgatggtaattttgtgttcactttcttcaactttttcttatgaagctattttagtcatatacagaagtagctaatagcacgagcttccatgaattcagcatctagcttcaaccattatattaacttacaaccaatatgattattactcccatcaataattttatccataaacacttcaggaggtatctaacatgagcacattatcattttcattctccaataataattctttaatatacccagccagaatttaaatttctggttaaatgccttaaattattcttttggttgcaagctttttatgaaggaaccagatcatttgtcctgttgagtttcccacagtctgaattgctgaaatcatctccttggagtagtttaataggcttctctgtcctctgtattgtctataaattggtagctagatttagaaatttaatcagattcaggtgtcttaaggtagcattttattttttcatcaggaagcacataatgagtggtttatttgggattttgtttggttcggtttgtgatgttagcagccaatccattaattcactgggagccataaaaatggtggtattttaattccataatatttttctttagtagctggaataattttctaaggagaaacgtacctgtttggttttccagtgtagcaacagttttaacattgtaatcccttcggctgtggacatgaagagaacagccacatctttctagaccatattaacccattatacatctgagatattttctccgataccatattgaaatctgtattagtctgttatcacattgctatggagaaatacctaaaactgggtaatttataaagaaaagaggtttaattggcttatggttctacaggctgtacgggacgtgatgctggcatctgctcagcttctggggaggcctcaggaaacttccaatcatgttggaaggcaaaaggagcgaggcatctcacatggtgggagcaggagcaagagagagtgagaggagaggtgctgtacacttttaaacaatcagatctcacaagaactcactatcagtaaaacagcacctgaggatgctgctaaaccattcgtgagaaatccaaccccatgatccaaccgcctcccaccaggccccacctcccacaattcgacatgagatttggtgaggacacaaatccaaaccataccagaattcatcagtgcttttcagagatgtcactgagtttctctaggacctccgtgctaggactaagaccatcttgataaatgccgagcttgaactcaggggtttaaacgtagaataaacagacttcacaagtcaggtttttcttagtctgtctggactgttgtaacaaaataccatagcatgggtggcttctgaataacaagtttatttttcacatttctgtaagttgagaagtccaagatcaagggactggcacatttggtgtctagtgagagcccactttctggtagacagccatcttctcactggaacctcacacggtggaaggggccctcgaagaatagcactggggcctcttttgtaagatcactaatcctatccacgaggactctgccttcatgacctaattgcctcccaaatgcccaacctccaaataccctacattgaggattcggtttcagcagataaatttgaggggacacaaacatttaggctgtagcaaggctggagctcagaaaaatgttttatgacaagcagtggaattttaagttctagtaacctccagtgctattgtttctctaggtttcggtggaccgggtcttaaagaccctgaaagaaaacgctaataaagccaaaagcttactgctcactaccatacctcagatagggtccacagaatggtcagaaaccctccataacctgaaggtaagtgtcagccatggacaatcaggcatgtctgtagactctctattgtcttcttttcttacttgcatttcacctttggtcctcatgtattttatgccagcctagatgttttcaacaagtttttgtgacatctactactaccataccaaccacttgtgaaactgagtagtcttattttctggctggtagtgcaagaccactgaaggctagggttgagagagttttattatctcgtgtaccagattcttcacattgccctgctctgtagtatccctaagtcttacttcagaagattgatagtgctttctctgcatatcgcttacattgttgacaaagctattttctctttggcagatccattcaaatttgtggcaatcctttaaagccaaaactctgacaatagtaccaaaatggtgccagaaaatatctgcttaaggttaatcatgcatcaaactaaacagtaattaatgataaaccaactctagtattctcagaatataatttaaactaactgataaactcggagttgcatgatttttctttgggcactttgtgactcttcttaaccacatagggaaagacttgtctcaaactgatcagatattgcattctcctactatccaaagaggaccataccccaaagtctcctagaatacacctgtacttttgggtcttctggtggtggtggagagaggatttgaaaggttgatctaagccctccttacctgaattaccacctaggagctctgtaatgagagagccacagttttagtataatgaggacattgtatggtggtaagtgactgccaatcactgggcatggcagagccttgatttgtaatgtttgctaatttacgtggtacaagtgctccagtacggccagtttcacactactaatgtgaagccactgatgagttgagaagtgatacacacagctcttgcaagctggtacgaacagaatccagcacaccactgtaactaaggtgtctctcagcagttaggactgacggtcaagaatgttggaatttgtagcttatcttccctactaagaaacaaatctattggtttcaacactgtatacctaggacctaaatgttatttaatgaataaatgatactcctttcccccatgaagtgttttatcataatatatagagatgcaggaaacccttattattagaattaaaagggaaaaaatacatttgagtgcagtcaaatggcacaactggagcttgcataaaaaaacgcatgttggtttgccagaaatgtgactcctacttgtactattgttagcaaaatgtcatagaagtttgtttgtttatttgtttgtttgtttgagacggagtctcattctgtcacccaggctggagtgcagtggcacgatctcagctcactgcaacctctgcctccctggttcaagcgattctcctgcctcagtctcctgagtagctgggattacaggcatggaccaccatgcccagctagtttttatatttttagtagagactaaacctagtagatgaccaacatggtttcatcatgtcggtcaggctggtcttgaactcctgacctcgtgatccacccgctttggcctcccaaagtgctgggattacaggcatgagccactgcgcccagccaagtttattttttttaagtctcccaactaaccccactttgaccatagtctttcaaaagcttgaagttaatttctcaaataatatatttactgttttagctttatttttaagtaaaaatgcttgaagagtagaaatcagtgttctcctttcctggagcttctgaaattgtaaaattgtgtgattttatttgtatgcatttttaaagaggcttagtttacgtagctttcatcggattttcaaaggaggattttatatatatgtgtatatatatacacacatacatacatatacacacacacacatataaaacctaaagagagaaaatgaggaattcctgctctagacaaaactgagaatcttggtcttcatgctacagcattaaggaacaccatactaataatccctttttctggggtagtattgttagcactgaaatgtgtatcattcattccctcactaagtcatttcagaaacacttagcacctgctatacgtcaaggtctggtttgcaaagataaagagttgtgatgatgatcctatggtgtttggagatatagacacataaaaatttcaatgatttcttacagtggggtaaggataagggatagaggttgcataaacaataatccaggctgggggctggtatggcaataagtgattatcagaacaatgctctgagataagcattattaacctcactttacaggaaagggaggtgaggaaccaagagtttagagtacccgaagttccacatctggttagtgaacttgaaaattttctgtagaatttatttaaagtgtatgtttcctgcgtcctcactttgatctagaaaatcaaaatctgtttttttttttaacaaacatctcagtaattacgccaacatgtgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttgttttgaagattcactcatgttgcatgcatctgtagcttgtgccttttttattgcctagtagtattctgtcatatgcctatcttacaatttgattatctattcacctgttgatgaatgtttgaattttttccatttgaggaattttatgaataaagctgctataagcatgaa

SEQ ID NO: 1157 - DNA, 26741 bp, Homo sapiens
atgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtttgaggatggtggtgttaaagaggagttacttatttttaggtacatttcatactaaacacaaattgcataatttgcctaaatcaaggaattatactaaattatattatggttattaaatcctgtcctgagaaagtgaaactgactcagttttcaaagagacaaagagaaagtataagcaaaccaaattgcagctacaaaaagaaagacaaaatgttgcagtatatttattgttttgtgtattcaatgaagtccttcgtcttggtcataaaactagccttaaaggtttttcttatatttcatagtatgaaaaatctaaaaagtaacccatatgtaaatatttaaatcatgatagaaatccaaagcaaaaagaaaatgaatcaattgaattaaaatgtgtaggatgcttaaacccatttgataatatatccatttgataatatactaatatgaatttagtactttaaaatgttatataaataaatgttcctatattaaacaccaatgtagttaggattctaagccaacatcatttccccttttctacatgttcttctcccgtctccattaaaaattgtcaaaactatccacttttctttttcctttttgtttttaaacaaataaggtctcttctaagatattgtaggactacaaagccaaactcccgggttcaagctgttggcaaaattttagagatgctaagttacccatgtattaattacttttaaatcctcccctaactccctcacaaaacaggagtagggagaggagaaacacctctgttcaaaaatgaggaattgaaaactcttatcacaaataaactatatcaagtaagctaaagatagtaaaagagcaaaaatgttagcagatattcccaaaatggtaactacatattacctctggaatgatcacatgaatgtggctcattatttcctaagttcctacagcaaacatatatttatttgccctactcagttaaaaataaacacaatatgtagttgcttctgaataatttttctctctctctttctctctttctttctttcgacaaagtctcactctgtcacccaggctggagtgaagtggctccatctcgctgttcactacaacctcagcctcccgggttcaagcgattctcctgcctcaacctcccgagtagctgggattacaggcgcctgccaccacccccggctactttttgtatttttagtagaggcgaggtttcacctgttggccaggctggtctcgaactcccgacctcaggtgattccccccgccttgatctcccaaagtgaagggattacaaggcgtgaggcaccgcgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagccggaagcagccctcgccagagccagcgttggcaaggaaggaggactgggctcctccccacctgccccccacaccgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggcaagggtttctcagacgtgtacattgcctggtataagagcagactctgaaaagatgaggtttatttaatacggacgggggagaattctgcctgtaggcagataggaaaatggggagggagtcattggaaggacggactccattctcaaagtcataattcctagaccagaaaaagtgctcagtgttctagaagcagagttgcacagtgatccaaagaccagcttcaaatactgtcctgtctccttcacacttctcacatttctctttcctactgaaaataccttgcatttttcgtaattataaagggggaagggaatatgagtgccccctgctttataggggttgttgtgagtttaaatgatgtattaatacatataagccttaagaacagtgccacacatcctaagctaatacctgttagctcttgaattatccgctttgaggactggcttgcaatcttgttttgaggcatagaaagaaaatgctttggagcaggacgcggtggctcacacctgtaatcccagcactttgggaagccgaggcgggcagatcacctgaggtcaggagttcgaggccagcttggccaaaatggtgacaccccgtctctactaaaaatacaaaaattagctggccatggtggcgcacgtgtgtaattccagctactcaggaggctgaggcaggagaatcgcttgaacccgggaggcagaggttgcagtaagccgagatcgcgccaccaccctccagcctgggtgacagaatgagactccgactcaaaaaaaaaaaaaaaaatgctttggatagaattatcactattacataaaaggaaagtccggatgcggtggctcacgtctataatcccagcattctgggaggccgagacaggcggatcacctgaggccaggagttcgagacaagcctgaccaacatggcgaaaccctgtctctactaaaaaatacaaaattagcggggcttggtggcgcatgcctgtaatcccagctactcggaggctgatgtaggagaatcgcttgaacccaggagaaggcggaggttgcagtgagccgagatcgcgccattgcactccagcctgggagacaagagcgaaacttggtctcaagaaaaaaagaaagaaagaaagaaagaaagaccaagaagaacttactccctgaaaagattatgggcaccctccaccaccctcacttacaaagaaaagttaaacagcactaaagagtataacaagcgcaaggaggtaaaagttctaatttttcctgtgactactactttttaagcttatcaaaaacatgtactacgttttaaaaaatggattgctcagactttgctgatgccttaagcacatgcttaatctgcctactggataatccagctctgtttaaaagttatatttcaatccctggttgacttaaaccttgtagacccagtatatcttgtacttttagtgtctgcttgattttaaaacatgtagtttttaaaatgaagccaatgaaaacaatttgggatgtcaagtatgttattaaaatctacaatgcattactgtaccatttatattttcctcggggtacctctcaattagctgtgtagcaatgatagggaaaattcaaactatcgataaataaaattattttagtttagtttaagatattttatgatggaggaggaagaaagtggttgccaggatgggagggagggaacacatttccatcactaatacaatggttctttctttttgtttgtttgttttgtgtgtttttttgagatggagtttcgctctgttgcccaggctggagtgaaatggcaccgcacgatctctctcggttcactgcaacctccgcctcccgggttcgagcaattctcctgcctcagcctcccgagtagctgggattacaggcacatgctgccatacccagctaatttttgtattattagtagagacggggtttcactatgttggctaggcttgtctcgaactcctgacctcaggtgatccacccaccttagcctcccaaagtgctgggattacaggcatgagccatcgtgcccggcctacagtggttcttaatgggggtgggagagtgggaagagtaggctccttcaagagtctgttgaaataaataccttcttctcaaaaaagaaagtaggtaatgattttttttaaaaaagatgtgttcacttgcacatgtatttctagataaaactttcagtgaattcagggatttctctgaaactctaccatggattcctacatcaagaactctttcagctcttgtgaaaaatatatatagctattggtgaagaagatgggagatgcaaccatataaaaacaacatttggatgcattataaacaggtgtaaaagttgactgctttggaaataccaagaacaagttttagatatgtatatctcatatcttgcagtagagctctggaaggattatggcatccttgggtggggccattttgctctagaaattgaagtccattatccattataaatcttatgtaggggggaggggggagggatagcattaggagatatacctaatgctaaatgatgagttgatgggtgcagcacaccaacatggcacatgtatacatatgtaacaaacctgcacattgtgcacatgtactctaaaacttaaagtataaataataataaaattaaaaaaatattatgtaaataattaataatagtgggaaaactttcctagtttttctgttaaagagcccattatactcccagtttactcatacatatcgacctgaggtgcaaaatcctagaagaatgaaaatataaagtcctggatctctgtgctccttatgccagtctcagatttcctatgtgcaaaatgggattataatatatttcatgtggccataaaatatgataatgtatgtccaaaagcttttaatgtaaaaatttactacatttactaaatttactaaagtttgttggttattgttattattattctcacacttacttttcctctttcctgagaatgccattctttttttagatttgcactgcctttgcagttttgaaaattctacacgtgaaatttaaacctgtcttaattctgatcagtcttataacaaaaaaagactaccacctgttcattcattcaacaagctcagaaactaagggcagacatggggtgggggcagaggggagtaggtcaaacatagtatctctacagtcagactgccagggttcaaacctcaactgttccacttattggttctttaacttttatcaaagttactcaacatgtctgggcctctgttttctcatttgcatgattaggataataactgtacttgcctcaaacagttgtttagggattaaatgaagcatgtaacgctcttagaagagcaaaataaagcacagaatgatacaagaaaatgaaaaggtgaccaaactcattctcatttgtctctagtaggcaaaggcttccggatgctgagagctgatcccagtcttgaagaatgatgtgagagtttaaagatggaaaagaaggagaaagatattctaggcagaggtaagaggatgtgcaaaggcatagaagtttaggaaaactgaaagtgattcatttagacttattcctgaaaaccagcctgtgaaggactcctcagagagccaaaagaaaaactaggataatgggatggcaaggaagtggggacactgcgttgactactctttcatagcttggttgtgatagttcaaggccctatgccatgaagtgaggcagatggaaggtggaggagacctgagcacacatatacctggaagggcaagtgccaagtgaagagaagggaaagttagaaaagaataaaagaaaagttaagtacacaggcaagataggatatttttgaggacttgaggtccctcaaaaataatgaagaaatagaactcaaagtacagcggtggttatagattttgtcacaagagatacatagatttgggagggagaaaaggtcagaacggggaggaagttgaggcacttccttctatgaatgaggaggttagcttgtttgcagagtgaaaataagatggtcggttaggaagtttgagaatcgtaaaggtttggaatacctcttatgagtagagaggatgggttgagtaagactcagacagagaagccttttgttttgttctttaaaaccagactggagaacccagctgagggtggagatcatgacacagtagggacacctgattactttctttaaactaaagaaagccctgcagtggtgctactacttcagcaaccctacaaatcaaagactagtcataatagatgtgaatattaattcaacatattaccataaagagacagaaagatacttgagaaggtagtgttccagagttgggttctggttctgatgcggcattgtaggattggcaatatgcacgtatttcatgggataagcaagatgattttgttaggaaaataaagggagttgaggcaatagctctacactgagaccaagtgacagttctcatgtatctaatgaactattttttgactgcaaaatcttttgagattatttctagattcattgtccataattttcaaaatgggctctctcttgttctattgtttacgcttgaggtgagataatacacacatatttctttaccagtttcaatattaacattattattaaagataattgttttaaatatagcttggtgttaaaaacaaaatatacatagaatatctctggggagatacaggaaaagctgttacctgtgaggtaaggaaatgaagaactgggatgggcatgtgacttacttttcacattccatgatttatattgtttgaattttgtactatgtccatggcctttctaatgaattaaataaacataataaaactagtagacaaataagttacttttattagaatcatcattcataactttagttgaaaaagagtaactgagtacctaatatatgtcaggcactcggcttaaagttgtcaatattaattaagaaagaaggtttcttagtcaagagcatgtattggtaacaaccatcaatatatttgcttctctgccaggcgcggtggctcacgcctgtaatcccagcactttgggaggccgaggcgggcggatcacgaggtcaggagatctagaccatcctaggtaacacggtgaaaccccatctctactaaagatacaaaaaattagccaggcgaggtggcgggcacctgtagtcccagctactccggaggctgaggaaggagaatggcgtgaacccggggggcggagcttgcagtgagccgagatcgcgccactgcactccagcctgggcaacagagcgagactccgtctcaaaaaaaaaaaatgtatatatatatatacacgtatatatatatacgtgtatatatatatatacgtgtatatatatatacgtgtatatatatatatacgtgtatatatatatacgtgtatatatatatatacgtgtatatatatacgtgtatatatatatatacgtgtatatatatatatacgtgtatatatatatatacgtgtatatatatatatacgtgtatatatatatatacgtgtatatatatatttgcttctctggaggaggaaggtggtcttgaactgggatgagctcttgagtggagcctacagtaatcatttgaggagggaagactggggtgatgcattctgataaatgacacctcacacttgtgttaccaggaaaaaaagatttcagagtctggaaaagctcccataattaaagagaattccttaggaagtagcttatgagagcgagatatatgccctgtaatggagctcccaggtacagctgtgttaagccttcatagatgagttctagaataggatgttgggtgcaatagataattatttgaaggcaaaggcaatggaggaataattccatgcatccctttaatttagaaaagcaataatgtaaggaaattagagtccctgtcctagttctaccacctactttgttaccctgaaaaaatgacttttttttttttttactagcttcaatgtcttgatctacaaaacgggtataatcacaaacatgtaaaaacagattgtggtttagccccgaagtgccaaagtgctcctgaagctgccccggataaaaattctgataatcgagtccaatgtgggtggtaagagcattttaaacgggaaagaaacactttcttaggtaaataattgcaaggtatttaattacttatgttccacaaggaaaaaagatagcttcagcatgaaagggagacctctgagaaagtagagcagacctccaaacagatttgctaagaaaaaacaatgtgtccctgggagtagatctctagaagtttcaaaacattggatgtttctttctcccttttactattctctatttaattaaattcaatatagcacaattatttagtatttgctataaggaaggtactcttttagaaactctgtgccaacttccctcattcagaattactgtaaaatttatcttcctactcaaactggatcttagtaaggagtacaaaatgcaaaattctttgatgtgttgtagatttaatgcataattatagttaagtcacaattttcaaccttagtttccaaaatgttaactgggtatagaattagcagtacctattatcatcttcccaagaatattttgaaggaaacttaaaagtatattacttattatatagcaggtatcttttctaaattatgtgcaaaacaaatgtgattttaaatctatgtgagaaatttactattaaaatatctctagggtgtactcttgtgaaatgagggatctttgcagctcatggagacaattattccttaacttttttgtaaattttttttatgttgataaattacttgtggcgaattacttatatctatttgtagctatttgatcagctgagaacactaaaagattagcacagtatgtatgtatgtacatactatatgcacatatttggtatatatgtatattatgtacagcacagatattgagaattgacctcatcctgaggaacaaaataagtaataaacataattagaggagataggcagaaagaaatagagataataaaaaattcattaaaagttgccaagaaaataatggctatcattttttcaacccccagctatgtgacaagcatcaagcagttttatatgtgtaatttataattccacagctgtcccatgggatagagagtattattctttcttcataatgcagacaaaaaaaaaagctcagagtgcttaagtaataaggaaaagaaaagttcaaacttaaggttctcagttctgtttgagaggtcctcactctccctactacaatatgttttcctaatgataatttatccagtacattgtggacaactcatcaatgcttccttttctttgaggactctgctttagagcaagttgcaaaacctgggccaagattactgactctccattttcagaaactactgtgcttctatgattattcttcagtagtaatacatagtgatagaaatttggaactcaaagacacgcaaagtcccctgaaagtcacttaattcagtcccctcatttttgaatgatttgctttcctgattaaagctcacatatttaaaaataattaaggaattagctgcacatagaaaatgaaaaactaccccacacaaagcaataattattaacattttgaaatacttcttcctttttctttgcttaatctttacattgtgaatattatgcaattttgaaatgagctttttctaacttattacagcattttccaaacttctccaaaaacacttcataaatgctacttttaacagctgtaacacatcccactggaaaaagttataatttacttaatgatgtccctgttgtcagatatttaaggtgtttctaattgctactaaaaatagtattgcagtttttcaaagggtagaaggctcttgaatatattgtaaaactgctttttaaaaagccaccattttgatttatagataacaaaatggaggagtggtacatattgaggaactatgtagctatggttactcagctaataaatgtttgctgtagctgttgaagtcagttcctctctccattctccattctttctatggccacagctacttaattggacttaatgtgggtggcgggaaatgccaaccatatccttaatcataattttggaaatgacacatatgcaagtgggacaagcctagtctttaaactcagatagaactgacctctcatttaccagctctgtgggcttgaataagttatgtaaactttctgagcctttatttcctcacctcacaaagtggggaaaataaaatttaccccataaggttactgtgaggaataaagaatgtcagatatataaaaatccgggtgcacggtaggctctcaataaatggtgctttttaattttttgagaatatatatgacatttactatgaagttattcatttaggtcatcaaaataaatgtccttttgagtaatttttcattaattcctgtacattctagcaggtatctgtggtttcaacaagcaaattctcttctaaaaggtatgatgctacctctgaattctaaccctctgaaaaaacagcttctttgtaacaaagtttcccatgttatgacagaagaatttccaaaaaaaacccctcattaaatcatgagaagtgacactggagagtgtcactgtgttcagtgtttcctctgcattcattgctacccacctccactgcttggagtgcatttcaagtggaaggtacaatggagaaactacagttaaaactgaggaattgcaaaatttactttctctaaactacttttcctaacctccctctttttcattcttgataggacagattttcccctctcaaatatgctgtcctttttaattgctaacacaagcatatataatatctcatttctgcttatgctgctgatgtacgcatgtgctgttagagttctgagataatgttgaaagtcacagataaataataatgtattcggttttcactactgggagtggaggtttaatattcatgtttcactgataggtttaacactggtttaggatactctaatttcaggggcaccatctacatggaagcttttctcatcaaatggagaatggttgtcccccttttgcccctctaaaaaactatcctttaaaagtagcttgctttcttgggactctatagtcttactgttatgttcaattttctgtgtcctttcctgaacttaggagagttctgaagccaatctcccctctgatattattaaagattgcaagaaaattttcttgtgttagaccattcttccccaaatcacattcttcacctgatatgtgattcaactccactcaagggaatcaacttcttgatgaaatataatcaactttgattaaataagtaactgcttcctattcatgttttagcacttttcacatacagatttaacatttccactcatgttttcctttgagtctctgggttgagggtagagttttatcttttgtgttgttacggttaagatgataacttccataattaatttttcaaaaaggcaatgataacagaatatactgtatgtttactctgtactgatttaaaacccccaagtcaatttagccttaagaaagcatactatttagtgtattttgtgttactctttgatatcctacttctaaataacttcttcacatttgcataaaaataactgaaggtcaccctccaaggtaggcattttgaatgtcgtaaggatgacagtaatgtttctgcctatcattcctttcatcacacagacacacacacacataattttttatactaaagaatttttagaaaattgttttggtcaaaactgttgattcagatattcagactgtgacaaccattctgaaggaattaaaaatccagttatcttcagtgattcctttggaaattattattctgggttattagatagatagactaataactttttttccagttttctaaagctaccttgatttcctgtcttagaaaacaggggttcacaaacactgcttaatatctctttaatgattatgaatactagaatagcttagaggtataccctaaaggccaccatatagatcttctgtacagatgtgaatttaaaagtatgcaaatttacactgattttacctaacaccttggaacataccaggagtctgaatacataaatatatttttattatgatatgtatatttttaaagtggagtttagaaatttctagctacactgaaaaattataatgaagtaggtatttactgtaaaaaactaatgtgctttcttaagggcatagtttaattaggcactataataactgacaaacgtacactgtgtaaaagtttacagtgactcttcacacatactattttatctacctcttattacgggactaccatagggtctcaggtttacagatgagaacatgaaagcactgagagtttctcatacttcattctggtaccatgacagctaataagcaaaagaaatagaatctgctcacaggtcatgtgaatgctaaagaaagtaatctttcaactgcacgcttcaagtggttcctgtgctggtgaataggtatcccacttattgcttttaaattaaggtaggaataagtaatttatatgtacagtcatatgagaatttttcactggttttattttggtcaaaaaataaatttttgaaagatgttaacctcctttcaaccaataaatatttactgtgacttatacggctgatgcttgagtatagtagaggcccaaaggggttaagcgactttcaaaataatagttaactaaaagagatggaactgaaaccatatacatatttatagcactccatgggcaaccaagttcaactatatatgaattactagtcaatgacttttggtaggccatgcaacctatctgagcctcagtctccagatctacaaaatgaaaaaatgaaacattgaaaacataaggatattgtgataattaaattagataatggaagttgaagtgtcctattattgttaagctcctcctaattgtttttgaagaaaacaataactttaccatgtgatttaggaagaaagtttcaataagcttttaaaaattaaatgttaaatataatatattcaacttcaactattcagcatgtaaattgcatggagtaaaattcaaagtgtccgatgttggacatttaacaattagatgttcaactgggggagtcattgttctctagacagctgctgtttctttaaattgggtgagagagttatacaattgctgagtcagatgatctggcagcctgaaagagaatgagagcaagaaaatggtggcactcgagaaaagaaagcaaaacaagctttttcctaatacatcagcaaagtcactggtgtaatattagacaaattttagcttaaaagcagaaaaatgatcatttgaaaggcatgatattttagtttttcttataattgttactttttagcttacatttttcatctatatttccccccccatcactgtgcttttacagagacataaagacccatcattttgtccataaatgctttattctgttatggctacattttcctgcaatcttgccctgatcttagataagcataagttaaacctgtgaaacacttgtgctttgatttttcttttttacataattttaggttgtcatgtttattacgagcctggtctggatcataaaatgaaagaaaccccttattacaacacacacacacacacacacacacacacacacacacagagagagagagagagagagagagatccattcatcctgcacgaacagaaagaagtgtatatagtgttttaaaaagacaacgtatcttatatagcttatgtggaaattttctgtctggttctgtaagctttaaaacacaaatatatcttgttatatttttttctctcaaactatgttctgactgtaaaaatgtggtatctacaagacattcttttccaattcatacaaagggtcacataataataaagggtctccttcatttggtgaaataactcctccactgattactcagactctcctccctgggatccagtaaactgactctaaacttaaaatcttacctaaaatcctggacctcaattcaaagataaagaagcagaaataaggtttaaaaagtaaaattggtcatatttgtcaaattgtgtcccaatgggccacttgtattagtatctccttcaagtgtttatttaaaatgcagatttctgggacccacagcaaatctgaatcaaattttctgaacgtgaaccccagaaatatgtatttttaaaggcagcccaggtaataatgctgttgttaacctttgccatacttttaaaatttctagttactcacataattcaattaagaaagcagaggcttttttatttacgttaccttgattgtacgattttattagtttcaatttgcttaagagattacatgtctttgttcatgtaattctgaacctctataaaacttttctctcttaaaaaaatcctactgccttcacaaccatttaaataatttatgatattttattttgaaggtgaaagagaaaactgagaaatagttgaattaaaaaatcctttgtgataacatgtttatattttcatgaacaaagccaataagtcataaaaattaaaaatcaacatactattttttgaaaggacctctgatgctttgggaatttcaatcctgtagttgatggctttcacttttttttcccttttattacttctttttgattgtagagttctgcccaaatgaaaccatcattccagggctcatgaattaaatgaatgcactgagagacactgacaagcactgagaatttcttcaaccaccctttttaaaaaacaaatgctaattggacataaatatgagaacaatagacattggggactactagatggaggagaaagggaatgagcgagggctgaaatactacctactgtgggtactgtgctcactacttgagtgacagattcagtcgtactcgaaacctcagcatggtgcaatatacctttgtaattaacctgcacatgtgccctctcctcctaaataaaagttgaaaaaaaatctacgaggcactatatttttaaaaataccactatgtacaaggcactgtgctatatctggaactacaaatattagttaaatagtccaagattcagtgggttcagagactctaagtatttgccattccctttagatggaaacgttctttggtccaccaagccctatcgttctgctctttggaaattctccctcactttcttcataatgccgtccttgactaactctcctctagcaatactattggttttgtatgtgatttaaaatcattcctgtaatttcttctgtttatatggcttcgtacaagagattcacattcaacaaatagaaaaaaaacgctattgacatttggtagcttcgacaattgtaaacacatgtgggtttgctgaatacacattaaaatagcatgaattaggatatggtaaatctgttgcggtcccaagttggtgggtttttctaggaagagtcagaccctttaaaaggaccttttatcatctaccaaacaaatccttcatttattaattcccaaggttttctccatcggttggcttactgtcatggaaattgatcttgttttaatagctacttacttttttttattctaatcaatgatttcatttgaaaagaaaattttcaaacatggggaaagctgcaatataagaagaaaacaatggagagacatcgtcactggaaaaatactacgggccactctctataccatcctgcacccccagatggagaaactgagggaagtcgtggcctttcaacactcttgggtctccatctggcttggaagggaacgaaatggctgtcaagagtctcagaagcgcactttccccgtggttcctccgggtaaccctgactcacttttcatctacccatcccctccaaaacaaggcctagccagttccaagctggagaggtgacccagagttgccttctgtcatgtcctgcctttcgtctcgagtccactaaccccactcagactctgtctgctcccacccccaccgcggccagtgaaatcccaatcgtcttccacgtggaaccccaggtccgcagttatgataacggatcacatcgctcctgcggaaagtgcgcgcggtggagtgataattggacctagcgtctaaattcttgttggaggacctcgttccagctgccagttaagcctctgggatccgcagcgtctctaggaattgagagagtggggaagttaggatccaggaggaggatggtgggggctgaggagtggaggagcagcgtgcatctcatctcttgtcgccgggcgggcgctctttcgggtccagggcccttgcacccccagcgtggctccggaggcggcgagacctgcctgaaattgattggaggggactagagtgtgcttgtggggtggggtagtgggggcggagagaagagatcccaagaagggcgccaagtgctgtgaccagaggcctaacacgaggcaccttggaaacaggtatagctacggatttatgggttttaaaatggaacgtcttggtgaatggacatagcgtgcatttcacagtctgacgtcacagccctcgcaggttttcccagaccttaaagccacgttctcgtgtatgacacttaaacaactcagtttccttgtctttcctccctccctacccatctaagggtagagaagctcttagttcatccactgtgtaggactgttaccgtgtgtcaaaggctttggaaatgtatattttactgatgatggtcatagcactttggaaaactcaaaagtgaaacgaagaaaataaatatcaccaaactttttcccaacccctctcatcctgcggaaaccattataactaatttggtgagagagagagagagagagagagagagagagagagagagaaactgtttactgtttggaatcttgctttaaaaaaacctgactttataatgcaatcatttaacagtctatgaaatattcttcagatacctgatgatccagaatgtaactgtaccataatttaacactttattgctagaattttatgcagtttttgatttcttgctactacttatccatctgtattaatctttgtcagaacctttctttccttaggatgatgcctgaatataaaatagctgaatgaaagtggatgggttcattttaaaatacaaaattgtttttcttgatggtgaagtgtttaagaggtggattaatctcattgggcaacaaatagagaagatattagtagttaggtatatgagaatcagaattcagataatttgtcttaaaaattcatattcaatgtaaaaattttatatttagaaaatgaaactgtacccattgtttatataacttaaactgccaaaataaagcaccacaaaaactttttatcacgttggtttttgtatcaggctgggctttgcagcagatggaggagctagggcaagcttgtccaacctgtgggcccgagggtcacatgcagcccaggatggttttgaatgctgcccaacacaaattcatacactttcttaaagtatcatgagtttttttttttttttaagctcatcagctattgttagtgttagtgtatttaatgtgtgtcccaagacaattcttcttcttcctatgtggcccagggaaggtaaaagattgaacacccctggcctacagtgttctactatgaagtttcagttttagttcggcctagaatgttttagtacagaaggcaagtgagattttctctgtttctccaaggacttttgaaaaagtgtaaaagcactgggcccactgttgaaccttgctataaaaaagtatttttgataccatttgtatcactttagtaataggagtttttcatatgttgggaaaatggtttagcttaactctatcatggtagttgatagtgatgaactaacgtggaataatagatctgtaaaccatcatagacggtaataggctatgttgttgctaccttaggatcataatggactttctaaaattcaagagtactcaaagaagtaaaatgaatataagtcttgatttctgaaagggctatggttcacttggaacacaatacaaactgtgaatcatgtacacatggggaataatggtttatactaactgcacagtgcttaccttgagaggactctgtgctattaaagaaaaaaataacctgagccttctgaagtagctataaacaaatgaatatttaacttcataataaaaatatgactattttgtaaatgcaccaaggtagaagtaacaaatcaactatggcaatttttcaggtttctgtggttaagaaactggtaacgtggaattttagtatatgtatttccaatcatataaaaataaaaagtcataataaacatatttgcagaaacttaaaaaaagttaaaataacatcttatttgcaatgatattaaataattcatacaagtaatttttagcacttgtgcctctcaaggaattgtatgaatcctaacataattagtatccatatatattcccaaatcaatatagccatgggcataaaatatattaatgtgaaatatataattacatatcattataattaacaccgctagattttatattatgtatatcattttacatatgaaattggaaaattgcatatatttcaagacattctatccaagctgtgttctatcttgagaaacttcctgaagattgcgcttttcacatacgtcctgaaaattgatttatacctaaataacaaaaaatgatctatttcaatgaacctatcatttaaatatttttgcatttcatgcatatacattaacatactataaaatattttctctaacttaaaatcaccacaatgttatgttttataggcctaaactaaaaaatacataattatggcatttatatacattgacatgttctactttgttactacagattttcagaggcaacttaataatttaaacaaaatgattttatatagaataatattaactagagtaataaatatttttatatagacaataatattaagaactatattcatacagttaccggtcacagtggctaaacttttgctgatacggataaaccactgttaaaaaaaacaacaaccagggtcttgtcaatgtttcaaaatgaattaaaatcaaatccagcaacaggccctgaaatcctttataagctcctttgactaaattaaaaaaattaacttgcataatatgaaaagtaaaaaataaaatgtgcatttatcctatagattataaatttttgctaatagaaattgagacactaaattaaacactgatagttttaacaggtttatatttccatgtcaaagagacaattaacattgcagtaaaaaaataattacccctccgctggcctttgctttttgaagctatatattcctggcgaagcataccacaaggacggtcataaaagtgaagcctcattaaattacttttagacttattacacaagttttaattagcattgtacatattttaactgtacatatattctttcagttttcctggttataggaaattacactggctgtgtcaacatttgtcaatgtgaggacaaaactaccttggattctgtttttcaagaagtaggcctcatttttaaactgtgctaactgtcgtctgagatgactaaaatactatcagttgggatttctcaggaacagttctacagttctgtcgtttgctaaacatacgagcattgtcccgagcagtttcaatcactcaggccgccggacctctacctctaactcacaaagaaagcccatttccctgttggctgcaaaactcccccaagaagcaagtgcttgctcctcgcagcagtaactgatcctacgatccttgttagcatttcaggaagtcgctgcctgcgtgccccgtatctcacgggtcctccactctcctggaaggtgggagagggtgaccccgccgggaggctggggagaaaaaaggccgcctccagaaaacttagatggttagcaataattctccccaaggagaaagaaagtgtgcttgaaatacacctttcctactgtgtgtgtgtgtgtgtgtgtgtgtgtgtgtgtgtgtgtgtgtgtgtcttagtcattcccacccaggatattcgggactcactgacttctgaggtgggtttagaagctctgttcgcctcagtttcccacgattgaggggctgtgtgaagggaggtccaggttcaatggtactgcgagaaccacatgtctaagtcgttgtaacccgaatggggaagcctccaccggcggttatctcctcctcctcctagcctgggctagagacgaattatctgtttacgaaatcacaccaaacaaaacaagtgccgaatgcgccccggacttttcgagggcctttcctacctggtcttctaggaagcggctgctgccctagacgctggctcctcagtagcatcagcacgagggccacagcggcgggcgcccctggcgctgcccactcccccgtgagccgcgggatgtgaaccacgaaaaccctcactcgcggcgggccgcacgcgcgccgaatccggagggtcaccaagaacctgcgcaccatgttctcgccgcctccagggccgagctcggcagccgctgcgccgccctttggcaccagaggtgagcagcgccactcctgcccccttaactgcagactgggacccacgcaccgccccctgcccatctccgccccgcaggcgcgcacccgccttccctgagcg

SEQ ID NO: 1158 - DNA, 7077 bp, Homo sapiens
atgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtttgaggatggtggtgttaaagaggagttacttatttttaggtacatttcatactaaacacaaattgcataatttgcctaaatcaaggaattatactaaattatattatggttattaaatcctgtcctgagaaagtgaaactgactcagttttcaaagagacaaagagaaagtataagcaaaccaaattgcagctacaaaaagaaagacaaaatgttgcagtatatttattgttttgtgtattcaatgaagtccttcgtcttggtcataaaactagccttaaaggtttttcttatatttcatagtatgaaaaatctaaaaagtaacccatatgtaaatatttaaatcatgatagaaatccaaagcaaaaagaaaatgaatcaattgaattaaaatgtgtaggatgcttaaacccatttgataatatatccatttgataatatactaatatgaatttagtactttaaaatgttatataaataaatgttcctatattaaacaccaatgtagttaggattctaagccaacatcatttccccttttctacatgttcttctcccgtctccattaaaaattgtcaaaactatccacttttctttttcctttttgtttttaaacaaataaggtctcttctaagatattgtaggactacaaagccaaactcccgggttcaagctgttggcaaaattttagagatgctaagttacccatgtattaattacttttaaatcctcccctaactccctcacaaaacaggagtagggagaggagaaacacctctgttcaaaaatgaggaattgaaaactcttatcacaaataaactatatcaagtaagctaaagatagtaaaagagcaaaaatgttagcagatattcccaaaatggtaactacatattacctctggaatgatcacatgaatgtggctcattatttcctaagttcctacagcaaacatatatttatttgccctactcagttaaaaataaacacaatatgtagttgcttctgaataatttttctctctctctttctctctttctttctttcgacaaagtctcactctgtcacccaggctggagtgaagtggctccatctcgctgttcactacaacctcagcctcccgggttcaagcgattctcctgcctcaacctcccgagtagctgggattacaggcgcctgccaccacccccggctactttttgtatttttagtagaggcgaggtttcacctgttggccaggctggtctcgaactcccgacctcaggtgattccccccgccttgatctcccaaagtgaagggattacaaggcgtgaggcaccgcgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccat

SEQ ID NO: 1159 - DNA, 6412 bp, Homo sapiens
atgttattaaatttataaatttatttaactttccagatcttcttggaataaatgtcaggtagtagaatttgtacaaaccttggtaatgtcttaggtttagatacgaacttaacaggtatatttaattttctgtattccacaatggagctagaagcaggactcatgaaaatagtaactatatgttttgcatgtatccttcaaagtgaaatccttaacaaatttaacagtatatattaggctgctgatgaaacagctaaacctgtctgccaggtggcttcgaaaatggaattaatttttacatggcattgataagttactatttcaatacaaccaggtggtaattgatacccaataatgtttgaggtttgctttaaataaaaaaaactaacaaaacaaacaaaaaaaacagtgtaatatagtactgtgggatccacaataacattttctttagtttcccttaatatcaggttgtcattaggaaagattccacaagttatttaaaccagaaatgaagtaacatgtttcatatctatttcaagggataatttttcatgacccagtataatgcaactagcaaatttaaacatcttggaatttaagatatagaggtcaaattaagggattttataaaccaaatgggagattttaaagtatcaactgacttcttttatatagaatgttttctaataattgtaaaatactgtaactttaaaaatattattcttgtagcctctaatgattgagtgcttaagtgataactagaaatatattttctgtccctgtgcttcagtttgaaaatggaggttccattatctttgttccaaaaatttgggtttttataggtgtgttggggggggttattctccatattgttgacattttaaaatagttttcaaacaaaccgtttatatttactagaagttagagaaagaaaagccaccttaggagcttacaagggagatcattgtgtatttctgcttttttttaaaaaaagttatcttcatgtgtatcattcatgattttggaggacaagctggtgcaatgggaagaaaagcaagacaaccataatcagctgtggaactagatgcacttctttgtgcatccatggaatgaatatcttgtaacctttggcaagttacttgatatttctttgcctcattgtcctcatctgggaaacaatacctatctctcaggtttaaatattaaattaacaaatatattttaatgcatacctggtacagattatgtgtcaataaacatatcctttccccaataacatatgctctgattctcaactaactttccccagtaatatgttcattttgggaataggaattggtagagaagtaaagatttgtgtattcaactcaaatgtactccttcttataagtctccactctcaaatgacttgtttctgttccttttttctcttttaaatgtgtatctggtagaatgagcatttagaagcataatacatgtatacactttgtgtttaattttctatggcataagtaagcagtttttatgaattgctggtattgcttatgagcaattattacaaacattgagagaagggaacccctgtgaacctttaacatttctcaggagttagtggtaaacccatgaacatgtatttttaaaccaaattacccacctcttggagttcaatctctgttaattctttattaaagtagtgaagtatcagttgttccaatgatataatgatcaagcaaccctggaaattaaatcccaaagcagtgcacctttagtttgttcagtgatagtaggacatcccacgagccatcatatattttcaagtttttatactcaatctactttttcagcaatcttttgggaactatcccaagataatttactgcataagtgcatctatcttctaaaagacatttggaatatttcttagtctgacctctgcaccctgagacactctataaaggaaacaatcagaaaaatttaacaaagaaataaataggttaagaagaaagcaatctaggcgtttgcactgagtttgcaacagtgccattgctacatttaagagctgtagttcttcctcacattttaactgagagccactagttatgttacttaaaatctccccattaaataagacagttgctgaacaactaaaaagtacaaaatatcacaaaatcaaaaagtagcaagtcataaggggatttccgcatcctagcatgtgtgtgtgtgtgtgtgtgtgtgtgtgtgaaagaaaacgttacagttaaccgttacaattgctctcactccactccaccacctcatcctgtgtagtctgcctgcggaacccgcgggaatctctcctcagtgtagtaagagcaaaggccagcatcctgtgcaaaggtgctctgcagcgtcgtgatccagggattttagcatctgtcgtcgcttgcacatcctctcttacccctctgctatctggtggagttgggcgagggtctccagggcttccagagagtgtcgtttacgcatgtgacttgccatgcgctcaaactaaagcgccgccggggacttactgaagcccacctcggccctcctccactttgtcctcagtcttcaggttttcctttctgccgctagggcctaagttgtgggttcaccataactcctcagcagacattggagtgaacgcatcgactgccgtcacccaagtgctaatcactgccttctcccactcagcgctggagtgggagattcatccatcggaagattcgtagccaccaggtccagtcaaggatttcatatgcactttccctcagaaaaccctgaaaagcaaacgacccctggaatgtcacacactcctaaatatccctggaaatccgcttctctgtgtttcgcttcatggtgagtgtcgagggccagataagacaaagaaaaaaatgtatggaaggttattcccggtcggctcctccttcctgtgagtctcagacaggcttgcaggcttacaggctttccgccgctccccgttggcagccttcatcgaattaggtgggtgggggtgggaaattgggtaagaaaataaagtcgttgtgggcggctggggaacctggcgtcagtcccccgtggctgtgcgcaggtaccctgcaacgtcgcggtggccccgctcctcggccaagtccacgggcagacgaccccaggcatcgcgcacgtccagccgcgccccggcccggtgcagcaccaccagcgtgtccaggaagccctcccgggcagcatcatgcaccggtcgggtgagagtggcagggtctgcgcagttgggctccgcgccgtggagcagcagcagctccgccacgcgggcgctgcccatcatcatgacctgccagagagagcagagtggtcagagccagggtgggggcaggtatgggagatgccggccggggcaaggcaggtggagccatttaaagaaacacctaattgcaaagttttcacccagtgcagaggtgttcaggtctctgatgtctggtgtttcttcatttgctgatgcaatccactttcccaccccaccttcaggttatactcagtacaaattaaatgccattttattctctaaacgtgcagagacaagaaagttgatggtaaagtgatgatcatcattatggaaaaacaaatcttgatttccattggaacatgggaatctattttgttaaatgatttaggggcagagttaaatttattcggcttttaaagttttaaattatttgccttgctgacccctcctccataatccaggtctacaaatatttattaggtagtcaactactgtttgttagaagttgggagtaatggtttaggggagaaaataaacaactaagtttttttctttcttttttttttaatttatttagttctcatagcaaatcccgtgcggaaggcttttgtttgtcatgtgtctgagctcataactggcttgtagtgtgataatttgagccaaagttggagattagaagggaaaagtaaattaaatcatgcaaaatcttataaaattataataaatgatttttccttaacagttcatcattttaaatttagactataatatttttaatgtaatataaaactaactatatttgtatactacaggattttataatagctaagatttaaaaatgttaaacagtaaatattttgctatataaaaagagcttgggccaggcccagtggcttatgcctgtaatcccagcactttgggaggccatagcaggcagatcacctgaggtcaggagttcgagaccagcctggccaacatggtgaaatcccgtctctactacaaaaaataaaaaattagctgggcatggtggggcgtgcctgtagtcccagcaactcaggaggctgaggcaggagaatcgcttgcatcctggaagaggttgcagtgagctgagattgtgccactgcactccagcctgtccgacagagtgaggcctcatctcaaaaaaaataaaataaataaataaataaatagagcttggatgttagcagtcaatcaggatgatgcataacttagaaaaaatgatgttttgcaggagtaatcctgtagcagccatttgtgtacatgaacattatgaaaacatttgctgtcatatttaaagtcaattataagacaatttttggtaactaaatgtctaaaatcgagttatttgttatgggtttatgcactttaaaatataccatttaattgaaaggcagtatacttctcatgttttgttggcttgtttcattaatattagaaatgttcatttcatctcttaaaaaccgtgataagttatatctactagtgatgtaaggatattttacatagaaaaaaaggggaaaatagctgctgttagtatttcagaaaatggtgaattacatatataacttgtttttataattattaataaaattttaagtttttaagatgcactttacaatatttttgctcctttaaaaatccctcatttgttataccattattctaagaattcaaaagaaatgaacacttctttaaaatctatactattaacaagatcccttaatattagcttagttttagagggtgatagtgaggtgagtactgaatatgaccactagccaacggtaaagtacaaaagagttgtccgagattgtaaaagaaataaaaaatatcagtactaattaaagcaggattcgtacttaaacattgaataagtgtattttaacaatgaagataaagatgcattatttatgaagatcctttgccattcaaaaaggacctaacagttgctgcaggaatatttttgtaatctgggcactgagtatgataattaaagaatgagaaacctatagaactatatattttttctcttatgcatcactcataagacactgctaacataaaaggaactaagtactgtggttgaggaatcccgtctcattctcaattaacctctatgagaaaacaatacaacagatttcatatagtagcttagaagtttacattgattttttccatgtactatgattttgtagaattccttaaatccaatctagaatgcgtaacttatactttacttatctttatcgttgaaagcagacagacaagataatcttcttccctaaataagctttccttttctccttttctccccaattcagtctattccttgcatctctgatcatgagatggcagaacaaaaaccactaaaaaaagcttaaacagtgggtttttcaatgtctctctttaggatttttgctgggtaaaagcctgttttacgcgtggaatgcacacctccggccaacggagactcctgtacaaatctacatcggcgatctaggttccagccccgatccgccgaggccgcgccccgcgttcgcgcgccccctgccggcgaggccctggggccccagctacctggatcgcgcgcctcccgaaacggttgactccgttgggatccgcgccggcttccaggagctgtcgcaccttctccactagtccccgcgccgcggcgctggccagaccctcatcgctgccgcccccactgggcatgcccttgttctcctcgcgcattccgcagcccccagacgcgcagcggcccggataatccaccgttggccgtaaacttaacgacactcttcccttctttcccacgctgctccggcgcactctctccttcctaggagacctgggctcagcttcattaccctcccgtcgtccttctgcggcttggggccccgtgcagtggccgagcggccggtcgttagctccgggcttttcctggcgctcaagaaccagcgggcgcgcctggattgcttctgggaaaaagcgcctagcgcggacgcagccgagctcaaagccgctctggccgcagggtgcggacgcgtcgcggagtcctcactgccccgcctcgctctggcagagtggggagcc

SEQ ID NO: 1160 - DNA, 7383 bp, Homo sapiens
atgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtttgaggatggtggtgttaaagaggagttacttatttttaggtacatttcatactaaacacaaattgcataatttgcctaaatcaaggaattatactaaattatattatggttattaaatcctgtcctgagaaagtgaaactgactcagttttcaaagagacaaagagaaagtataagcaaaccaaattgcagctacaaaaagaaagacaaaatgttgcagtatatttattgttttgtgtattcaatgaagtccttcgtcttggtcataaaactagccttaaaggtttttcttatatttcatagtatgaaaaatctaaaaagtaacccatatgtaaatatttaaatcatgatagaaatccaaagcaaaaagaaaatgaatcaattgaattaaaatgtgtaggatgcttaaacccatttgataatatatccatttgataatatactaatatgaatttagtactttaaaatgttatataaataaatgttcctatattaaacaccaatgtagttaggattctaagccaacatcatttccccttttctacatgttcttctcccgtctccattaaaaattgtcaaaactatccacttttctttttcctttttgtttttaaacaaataaggtctcttctaagatattgtaggactacaaagccaaactcccgggttcaagctgttggcaaaattttagagatgctaagttacccatgtattaattacttttaaatcctcccctaactccctcacaaaacaggagtagggagaggagaaacacctctgttcaaaaatgaggaattgaaaactcttatcacaaataaactatatcaagtaagctaaagatagtaaaagagcaaaaatgttagcagatattcccaaaatggtaactacatattacctctggaatgatcacatgaatgtggctcattatttcctaagttcctacagcaaacatatatttatttgccctactcagttaaaaataaacacaatatgtagttgcttctgaataatttttctctctctctttctctctttctttctttcgacaaagtctcactctgtcacccaggctggagtgaagtggctccatctcgctgttcactacaacctcagcctcccgggttcaagcgattctcctgcctcaacctcccgagtagctgggattacaggcgcctgccaccacccccggctactttttgtatttttagtagaggcgaggtttcacctgttggccaggctggtctcgaactcccgacctcaggtgattccccccgccttgatctcccaaagtgaagggattacaaggcgtgaggcaccgcgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagccggaagcagccctcg

SEQ ID NO: 1161 - DNA, 617 bp, Homo sapiens
gttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaatgttgacaataaatga

SEQ ID NO: 1162 - DNA, 6412 bp, Homo sapiens; identical to SEQ ID NO: 1159

SEQ ID NO: 1163 - DNA, 7383 bp, Homo sapiens; identical to SEQ ID NO: 1160

SEQ ID NO: 1164 - DNA, 5634 bp, Homo sapiens
tctctgccaggctcacgggacagctgcacctctcagcgtctccagctccaggacgcggtcgtcccaactccttccgagtggaaagagtgtaaaacttttgtccgtgcgcgggtggagctcagtaggaccacggcgcgtcctgccccggcttccccagcctcccagcagggttagctgcggtcagcgcactttccacttgggactcccggccagaaatttctcgggaatggagcggtcacagtgtggcagcagagaccgaggcgttagcggccgacctcacttggcccctgggctagtggtggctgcccctccgcccccgtccccggcgttgccggtaccatcggggatgcaggttcccccagcgttcctgcggccgcccagcctctttctgcgagcagcggccgcggccgccgccgccgctgccgccacctcgggaagcggaggctgcccgccggctcccgggctggagagcggggtaggcgcggtgggctgcggctacccgcggacgcccaagtgcgcccgctgtcgtaaccatggtgtggtgtcagcgctcaagggccacaagcgcttctgccgctggcgggactgcgcgtgtgccaagtgcaccctgatcgccgagcgccagcgcgtcatggccgcccaggtggcgctgcgcaggcagcaggcgcaggaggagagcgaagcccgggggctacagaggctcctgtgctcggggctctcctggccccccggtggtcgggcatccgggggcggcggcagagccgagaatccacagtccacgggcggccctgcggcgggggctgcgctgggactgggtgccttgagacaggccagtggttccgcgacccccgctttcgaagttttccagcaagattatcctgaggaaaaacaaggtgagttggtctttgatttactctttgctcaaggaatggttgttctggaaagaaactctgaaacaagccaccgtgtccataggcgggcaggaatagttgtttaaaagaaacactttaagttttggggaactgctcagcaatatggacattaatgagagtgtgagagaccccatcgccttcactttggaggaatttactgttgttccctcaggtgataggatgagataatgaaaaaatgaagcatgggtggtaacaaatgagcaattcaccctaggagtagagttatttactcggaagttgatttgactttcactgtgtgagtagaacttcaagcaggcattgagcgaaaagcttcgtaagaggtgctgtgtttgagtctgctctgtactctttccagacaggatctcactctgttgcccaggctggagtgcagtggcgccattacagctcactgcagcctcaacctccccaggctcaggtgatcctccctgctctggactgttttcagctgtaaaaccagagctgattttgcgtgggaaactctgatagttggggatgcagttctttactacatgttggggcaaacatttgttgcaagcttgatgtggggaagagactgaaatctaccaaaccatcgtctttctttgtttcttcactctaaattgttttcgcaaaatgtaatttgtaaaaccataggtaagaatttcaaagttcaatattagaggttttttatccaaggagttttcattatttttctcttattttttgactgcgagtcagttgccttcatttcctgcgttaggagatatattttagtgaacttcatagccctccacagggcctactaagcagtgaaaatatcattgtgattttttttttgtataagtcaaaaacttatacaaaacttataaagctgtattatatgaaattgtatgatagctatacagtaaactattaattagaaaccttccttgaattatgaaaattgcagatctcaacagattttttcgctcaatggctgcttgaagttctactcacacagtacattcgaaaaattctgtgaattgaaatgaggcattcagttcagagtgaattttgtgtttgcatgtgtcaacttttgcacatattctaatttatttgagtaggcaaaacagactttctacaattcccatgaaagatgaaggtgctaaagagcacagttattaagtaaaagtgctatgaaagagaagtaaaagtgagaattcctgaaactacaccgatagtgaaatggctgacatctccctgtgagacactgatttatgtgatttctagttggtaccaaagtgttctgttttatagagctaattattttactttgttctttgcctcagatgatgccccctcccccataagaagcaagctaatgtttgaaaggttacttcaatagctttctaaattgactggttctcttacacaatagccatgaactgtggtaaaatagtctatttaatttactcattcattagacaaagactaacagtgatttagaagtgaacaagtttttcctacacagaagaaccttatattcaaaagaaggcagactatatgtatccaaaaactacaatgcaaggcttaatatacaatgataaatgcaatagaagtaaagcaagctgtaggacttgagaagacagagagacgatataagtggtattatattttaaagacaccatattttctaaataatcttatgcaaattggtatttcattacatatattgtactgtgagtaaaatataacaagacattattttatgatttcatgcataaattgctatagagatgaaatgttgataattgacatgttcgggggcatgctcattcatatttacaagtaaagtggaatggaggactaatgctaatctatttccacttggcaaatttcattagaaaagtattattgtgttatttaaagttgaaaatcctatagagtgtttgcaatttttgcagtagtgacattctttttttcatatgcttatgggaacagcatataggaacagcattttgaacttcaaaatgctaaattgtatacactttaattttaaaataaactatagctatttctttagaatttagaactgaattcttcttaagaaaactggagaaaactggagtattgcaaatcatatttacaaatcactgtcttaggcaatatttgttttgtgacattcataaacttggtagaaaaaggaagttggacagaattactctgcacactccacttaacagtttactcttacctatatatctctagggtaatagaaaatgtaaaccaaagtaaaagttacatagtaaatatggctattttaatttttgtggtgttaacctagtaaagggtattaacatattcttgtttgattaatatgctcaacatgttgagatagaaaaaccagaactttgtgtaaaagtacttttggaaaattgcccctaacattggaggagggctgtgatttaaagcaaatgcctaatatgttgtttttaaaagacaatttgaggatttgtgtagattgcaataggacagtttataattttcttttacaaacaatttgcttttaaagtctgttattgatatttcttaaggattgaaaaagaaagtacatttcatagaggattatgaaaaataccgtctgtgtcatctctcataaaatgaaatatgcaagctctagtatgatttgggattgacatagcaatagtacttattggtttaaatctgaaatgaaatgaacagtttttttttacattattcaagtaaattaattataacctgaaatatgagataaaaaaccaattgttaaaatttagcattagtgattaaatagaatattcattttcaaactaagattattccttttattccttattcattttattcagttctctttccatagtgtcattctgaaaaaatatcacttagataacaacaaaacttaggtgacatttaggaagatcccacacaaccaagatagaacagacagtgtgccatattggtgttatgcagacaatttggggtaacaatacactctcatcttctgattcctaaatataattgcattttaatattgcatacctttgtgattctgagatgatataatagtatacttttcactattccagcacctgcatttctgaataatcttttaaatttgagttattcattaaaatgtcttggagtgtataaatattactaattaataggagtgaattaattatattatccagcattatttttgagtgagcagtaccacattctgggaagtcttccctgtatttgatttttttttccccctcttctccagaacaaaaagagagtaaatgtgagtcatgccagaatggacaagaagaactgatctccaaatcccatcagctttacctaggatcatcttctaggtctaatggtgtcattgggaaacaaagtatcgggtcatctatttcagaatactccaacaagcctgatagtatcctgtctcctcatcctggagagcaatcaggaggtgaagagagtcccaggtccttatcatcctctgatctggaatcaggaaatgaaagtgaatgggtcaaagacttgactgcgaccaaggcaagccttccgacagtgtcctcaagaccaagagatcctcttgatatccttactaagattttcccaaattacaggcgcagccggctagaaggcattctacggttctgcaaaggggatgtggtccaagccattgaacaggttttaaatggcaaagaacacaagccagacaacaggaacctagcaaactcagaagaactggaaaacacagcctttcagagagcttcaagttttagtcttgctggaattggttttggaactctaggtaataaatcagctttctctcctcttcaaactacttctgcttcttatggaggtgattcaagtctctacggcgtaaatcctagagtaggtatcagtccattaaggctggcatattcttctgcaggaagagggttatctggttttatgtcaccctacctaacacctgggttagtaccaaccttaccttttcggccagctttggattatgccttttcagggatgattagagattcttcctacctttccagtaaagactcaataacttgtggcagactgtacttcagaccaaatcaggacaatccgtaatgtatatgcccattctctctttctggagtttttccagcatacaatacatgcacgtgcacacacatacacacacatccattaatatacttcagtaagtatgtgagtggattatgaggtcttaaaatgctgggttttttttttttcaagcaatataataggtcttagatctgaaaactcttcattaggatttatcaagtgaaagaagtaaatctgaacattatatgtgccttgaataaagctatttcaggaaatatttaatgaattttctccctaaattatcatttgtaaacatttttattttaaaactagtttttattttattgaaaagtggaatttttagtgataaaatacatttgtaagtgtaaagcaatacagcataatagaatagaatataaaccgaaaggaagaactgaacaattaaggcaattctaaataattaccatttcaaaactgtttcttctattcctggttcataggaaagaaaaaagttattcaaagtatttttaaagcatttgatttgcagatgggtgattcgtaataaataaaacatttgagcattttg

SEQ ID NO: 1165 - DNA, 1135 bp, Homo sapiens
acctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaa

SEQ ID NO: 1166 - DNA, 81036 bp, Homo sapiens
tttgagacagagtttctctcttgttgcccaggctggagtgcaatggcgcaatcttggctcactgcaacctccgcctcccaggttcaagcgattctcctgcctcagccttgcgagtagctgggattacaggcacgtgccaccatgcctggctaatttttttgtatttttagtagagacaggatatctccatgttggtcaggctggtctcgaactcccgacctcaggtgatccacctgcctctgcctcccaaagcgctgggattacaggcgtgagccaccgcgccctgtcagaacaaactttgtatgtacttctccccatcaagaatgaagaagaatcacttggttggctggaactgctggtaagattcacattttttcctcctagctcaggagtaggggaatggggacaaaaacagtatcttacatattggcttcactgaacaaagagaaggacacagaagagaagcaataacaaaaccttgggcaataaaaccagtagcgccttcccgtccaagacttggtgggccccttgaaccaaagtgctaatgggctcataaagcaaggaacaaggtcacccctttagtgaccccaaggcaggacatctatcccagttatagagaaagagcagtgaccaattcatcactgttgccagctgcacatccaggcagcaaatgcaaggaacctgctgagtgacctccaagacaaaagacagtggagcagcattcagagagtcttgagggaagaggggaatgaccttgagactctactcccaatcaagtcgtcattcccacataaagacaactgttcacacataacacaggaggcctcagagtagtggcatggagaagacatacacgagaaagctttagaggaagctcaacattcaagttaaggaaacaacttccaggaaggtcagggttggcctctgctatccttcctactcagctcatggtccagagcccagcatgaggggctacctgtgcacaggccttggtcagttttcagtatgggggacctcaaggttattgtacatcagcggctccctgggcaccctataaatagcactttgccacatgcatttacagaaggtactcctgctggctccattttacttcaagggcatcacaacatggatggcccagttgagagtgaattcccaagtcccaatgtccaggtggccatatggtattctgcttcatagctgttctagggcattgcggtgatatctactaaccaaacataaccaaaagcccacaaactccagggattagagtgaagaccaaaggaagggagtaacacataaagttcagacagcaaaaggaacagacagtggaattttgtctctgacttagaactggcaccagtgagtgagtcccccaagaaactattcctgggatgagcagatgattgtatccgaacctggtctgacgaggtcctgaccccaagtagctagatgggtaccctcaatacttgctggtttgccctttgccgagagtttccaaaaagaacaaggacatacttcatgaacctcttcattgcaactttactgtatttttcctaacatccccgtccccccgttctcactgaggcagttcccctttccacctgtgggctcagataaataggtggggcacctggaagtgcagataggcagtgccaggtctatcaagccctatgaccccacactgggccaccttgctttcagtcttcctgctagcatgaaagggcttaggacacagaaaagctcctatctcgaaccaagccagattcccattcctgggtgttgggggacagcggaggaggaccaaaatcaatcacagaatatccaacactggtgtttgggaagctgaactcggggctgacaaagggaccctatgacagctctgcgcacacccaactggctgaggagagggagcagcagacagatttggctgagtgactctgcagggtcactctaaaggcaaggaagactgtggagggtgggggacatgcatgcaccccttcctcccctacacagccagagctgatggccacagcccctccagtggacacgggtagaaaggccctgcagggcaggagaccctctgaagtggccctgtttccatcccttccatcttcaaagtgcattatcagtgcaagaagtagggctggatctcagggggtccaaccctgagaaagggctgtgcccgccagctcccctcatctccgctggctgtcccccttgcccgccccaatccttttcgtgctaagaccagaactcctgctggatctcataaggggcaggcctgtgtgtgttcagttccgctctgcacagcggcacggtgctgtcctgactctgcccctctgcatccaggtccaggagcgtccgctcagtcgggggcagcggccctgcctggaacgggagcagggctggaagtccaggccgctcctctacagtgctgctactgctagcaaagcaggagtccaggttgctgggcgtctctgtgctggagctgttggctggggaggtgctgcgggcatggctgggggacacaaaccaccaagggtccagccgttgccggttggcagaaggacgcggccgaggcagaaactccagagtcttgggtctctccaaggtagagtcctgctgagtgttccagcgccttggggttggggggaagaccacattggggtcagggagacgggggaattcacctgggtctcggctgggactgggggttttcaacattcctggtcaaaaagacaaaaggagaagcatcagatgaggcaccatatttcggggttagatatccgctactcccccccaacaccaccatatccctacgcaatcaggagaacatgaatcaccaaatgtttgtggagcacctactgggaggcactggggatacagtagtgacctagaatgccatgatccctgtatctgataagaataataggacatttgggggtcacatgtaatgaaataactgaaggcagatgttggcaaatgacacacaagctggccacctgtgtttataaacaaggttttaggtggagtacagtggctcatgcctataatcccagcactttgggaggccaaggcaggaggatcacttaaccccaggagttcaagaacagcttgggcaacatgatgaaaccccatctctacaaaatttttttgcaaaattagccaggcatgatggtccatgcctgtagtcccagctacttgggaggctgaggcaagaggatcacttgagcccaggaggttgaggctgcagtgagctgtgatcacaccactgcactccagcctgggtgacagaaactttgtctcaaaaaaaagaaaaaaaggtatacaataacattttattgaaacacagccacatccagtgtctgctttcccactacggcagcgtagtttagttacaacagaaactgtacggcctacaaagcctaaaatatttactatctggcccttcaccaaaaaagcttgctgcctcctgactcaagggcatgtctgttcatttactgctcatccatgtaataaacatgtgacgggaacagagctaggtatcagaagtccaaaggtgagtaatgtagggtttctgttcccaaagaggtcacatatctgagtataacaaaaaacaggagggcaggtcaagccaaacagttaaatacaactgttgttgacacttaaatctcattgaaagggtattactatgcccccttttcctactggattagaggctgtttccaagtcagacttaggtcttccagggagaaagagatggtgacaggaaagagatggtgacaggaaagagtgtgtgtccccaggtgtcagatgtcgagggcagtcatatgcacggggatagcaatttgcctggactcatctccacgcctgaagaggcaggtatgagtcaggggtgagtgttgaagagtgtgatgaatgggtggaagcctgccttctgagtgtgtgtgaactaatgctataatgagaggcaaaatcccagctatgtggcagaaaatactgctcccacatgcagtgcaagattccttcctggaaaatgcatcatcctcctcagggaataactagaagctagactcctgcccttcctgtgccctgaaaacactaccctaccctaagactcagggtctggacattccaaaggagtcccaggtcttctgattcttcctagaacctgcctgtcttctttcaatcctcagggaagacccctgaggcacaggtcagagaaaagtcagccagccctggctgcctccctgatcccagatctgtatttcttgattggctaagaggaggaatggtgttcactcaaatcccgaagtggaaagagaaaatgaggcctgcaaacatcttcactccctgaggaggcacaaagaaaggaaagagaaaagaggaagaagactcacctgctccaggactggggctcaacccattgctggaggggctcctgctggctaggagagtctctggcttaagggccccatcagaaggagtccgccggtgactgctgggctgcgagggggtggtgagggtgacatgggtgggagtcagagattggttaggatctcgtttgaagcgctctactcggacattgaccagggggttgtgggtacatggactcaggggaggggcctcgactgggctgactggcatctcatacacgacaatttcatcgctgtcggagcgcagcagggagcgtgtggagttgcactcggagatggaggagagggagagcagcgtcagggaggcagaggggtctcctagcaacagcatgggctcctccttcttgaaaagctttcgggatggggggctggtgctccgacgaggacggctggacctctgaaaaagaccctcccgtcttttcttctcctcccgggctggtggctcaggctcctccaggggaagcagctggcacttgccagcttccagcaagtcaaaccctaggcctgtggctgccagaacagccccacagccgagcagagccacctcgcagcggcggtggtgggcaccgccccgcttgaggctgttggttggcgtcagctgaggggtactcgtggccgagttgactggggtgggctcctcatggattccatcactggaggggccatcgccatcctctccacgagggaatgggatacagaggtaggactggctgggtgaatgctgtaggcgactctctccactccctgggccttcactgtcctcatcctctgtgaagatgacaagagtggaagagaaacaggaaatggaaatgaggtggcaggaataagaatctggccctttcccctcaccccaggcctcctgtctcagtctcagggacacaaaggttcaatggtgtgatgagcaggacatggaattgaacactgaaccaagggggctttatccaccccccaacacagggaaaccactctccattccagagcccatttccttagagcagaataaaagatccgctaatttgccatttctttcataagggatctgtgatagtgacttgggtatccacttgactggactgagggatgcctgcatggctggtgaagcacagttgctgggtgtgtctgtgaggctgtttccaggggagactaagatgggagtcagggggcagggagaggaagacccaccttcaatgtcgatgggcaccacccaactggctgccagcaaggctagaacaaagcaggcagaaaaagggggatgctcagtttgctgagcttcctctctctgtttctcccttctggagagggacactttttctcctcttgcccttggaaatcagagtccaggttcttcagcctttggactctcagacttgtaactgaggcctttcggaggctctcaggcctcagactgggagctgcactgctggtttccctggtgttaaggctttcaaactgggattgagccactctactgtcttccctgggagccatactacaggcttttctcattctccagcttgcagacggcctgtcatgggactttgcctttgtaactgtgtgagacaattctccctaataaacttccttttggttgctattggttctctccctctggagaaccctgactaataccggccccttaatacaagtgtagtatgagtttctagaacactgaacattctagaacaaaaacattcccaatgtttcctccatgaagcagtgctaggggtccttaaatggtcctagaagcttgggcaagaatgcccccagggagcagggagacagccaagactctcaagaggagctatgcttacccatctccataaggctggtgaaccctggcagggccgggctactccttgggcccttcaccaggttgggggcactggacgaccactgcttatatccatctaccagggacttgaggctgaatcagaggaaaagaggaaactgtcagaactggttacctttcttacttgaccctcagctccatgggtctatggagacgtttctccctgcctgcttcattctaccaaagaaccttggagtacatacaggcaatgactcttaccaagcccacctgcttcacaaacagaaatgcacatgctccagggaagaaaagggcaatgacatgacccatccccctcacatgctgctgtggaactgtagaaagaactagtgggcaagctggcaagcagacagaaagaataaggatggccctgctggctgggggtcttgcctgagcccatctcaagagagaagcactcgaagcagacactggacacaacacattcatggcatgacagttacggtgatgcaaagacctgcgaagccaggcaagcaccgggcagccgagctagcagaggtggaccaggctactccacataaggcatttctcaggctttccttccaagctttatggcatgcttaggcaactttcaaagccatcccctttttaaaaggcaaaaccaacccacaaagctgcaccaacccagtgcactgtgggacagacctacgtgggtagtgcacagtgctgaagcagagcccttggtctgtctgggggtggagagacagaggacaggagctcgctttcaaatccctgtcatcagcccatatggaaagccggtaactctccgaggatacagcctgggcaccctgccaaccactttgtaggaggggggaaccagaggcctagaagcactggtcttttccctagaggacagtaaaagggaggactgaggaatctgtgggctatggttgccctggaaatattgggattatgaccagagtggctctttttttttttttttttaagtctaggaagaatcattcaactaaagaccactttccccaaagtcccagccatcttgagagagacagaggaccaactttttcgctgttcagaattctgtttcaagtgctatcagaaataccagcaaattaaagtacatcccaaccaccactggtttcaaccaaaatatagtcagagataagcctgctgccaaacccacagcctggggcttcctactgagactctcgtaacatcacttccagctctggatccaggaaaatccagattagtaaagtcaaaaccagtgctgaagaccaaaggataaatagccacatatctaagcctctctaaaaccaagagtgccaggagtatcctaattggagtggtcagtggagtgaagaatatggtaaaattagatcaacacaggaattttcccaaggtgcacaatggtactgcttaaaacaaaaacaaaaacaaaaaagtcagttcagccctggcaataacgaggcttgattctatggggtatgctgtaagaacaaggaaatggaagggagattgttaccaggacagctggtgaaagggtgaagatgagactcaccccaagtggaaatgtggagattctgatggggtacttaaaccattagctttctcacgtctctgaggggatcttcaatgaataaagagaatcagtagcaggcaatggagggcacatccagctcagcctctcccacaccaaaacacccaaggctggattcacaccacatcgccagctgccttcccactgtccagacacaaagcccacaccatgaaagaatcttaacaagatggtcctgtttaagccaagacaggcccaggacaaagatccctgggcagctgcagcacggttgcagggggactgtgaatccatagatacccaagcagtctatagacaggtatgcatgttttggacaaatatgtattattttttaaaaggatgaggatgcaaaactcacttaacattactgaattcaaaatggcttttgttcatcacgtgttttctttagtcaaaaggtactaaaaccagaaataatatcacatagaagttctcaaaatttctgacattaaaggggtcttcactcaagtctggatagaatatacttttatttcttcaataggaactaagactcatgaaaaaattaagtcatatattttttaattccttcaaaagtttgtgaggaagaagaaaattccgaagttaatattttgcaatgtgaaataaagttaatttactaccaagaccaaaagaaaaaaaatatttaaatcaagagactcagggtgactgagtttctcagacccagctcaaccctactctagcccagagctcaagggacaaactggagagctcttgctcctacaaaacttagtagaagaatctgccatcccccaaggattccatcgctggattcttacatagctgaggtagtttgccctacatatctaaactttctgctcaaaggtatctagtgatttacaaagcctagcttcagagagtcaatcctttatgaatcaaactgttatttttaccttcggctcagatctgacatgggaaaatcatagattttggacatggaatcttagtgtttaaaggattaccaaggccacttgcaggttcagggcacttgtaagcctaatattcaacctgagaagctctttagaaagtcactaaaaaatgtggaaggagactgctggctatcctcgcacttatttaatagaaacatcaagaaacactgtgctagcttctaacaccaagaatatgaagtataaacggttccgtccattcttcagatatgatgtaaaattgcatgagaagcaggaagtgtcatcacagctaatatttacatacgctcactatgggccagctcatcctctctgcactcacaaagatgaacttatttggtccttgcctcaactccatgagatgggtactaatgttatgccatttataaatgagaaaacataacgtcacacagctaggtgtggtggtgccagggttcatgcccaggcagtttggtgccagagtcaaagatcttcattactacactatgagtgccttgcctgtgaagaacccagactcaggggagaatttgacccccaggactcaagcccacgagtgagaacacaagcacactccaggctctcacccctcttgtgccctgcccagaggagccatcatacatggcagtgtggctatggggtgagatctgaaaatagttctagcggccctggagttgtatacaactgtactaccagggctgggttattctgcctgcccctgcttcagcatgagcctctaggcaagagagtcctgttaacttctgctctttcttctctttcctctgctttaaaaatggaagaagagccaggtataagcagaacaccctggcagaactttttacatttggttactgcttgggctacttgctactctgagtagaacgccttcaggggttggcaaactataactggtgggttaaaccctgcccgccacttgcttttataaggttttactggaacatagccacactcgctcatttacatgttgtccatggtctctggaggcttctgtgttccaacagtggcgctcaagagttgtgacagggccataggaatcacaaggcctaaaatatgtattatctggctctttatggaaaaagttttccatgcctgttctaggacgttccaggaacttggagggtgaaaaactgttgtaaagatcaagaagcttgtaatttctcagaaagcaatcaaacacacgacagagaaaaaaagttatttcatatcctatgtttaaatggtacatccatcttcaagagagaaagaatttcatgtcatctggcacttacccttcatctcccgaggcaagctccttctgaccaagcgtccctggcccccacgtccgtcccttcttctttggggccctcttctcctcctcctccccttcctcctttgggacgactgagctcctgccccaggttttgctgctttcacctggtgtcactgtgaatcacaagggttggataggatctagaaaatggacagacagggctcccccaaactagcctctataccaccacacacacacacacatttggagctgcagggaagttagaccttatcaaaaactctgtgcccaagtggacccttccaggaaagtaatggagttctcagccaccaatcatttagctctctcaaagtactaaacatggaaacacttcttcaattttcacaaatccaatgtaaagctagagcttaggccagccagacatcagagttccaaacagatctgactttacctgttttgttgggtgggattgggtagtgagcaaataaggaggcaggtaaggggggaaaaaagacaaggggtaaggaaggcgtggaaatgcaggaatcttggaaagaaagggttgggaagaaaatgaggagttcaaggttatggaaaaggaagtctggagtgggagaaggggaagaaagaggcctagagaaagacagataagagaggaggaatatttttctgacattaataccttggagcaagggttgagacccaaatgccccagggactgtgcttatatcataaacgagcaaactagttaccaaaaaacaaggagttgaaggggctgaggcaaaatatggagtatacggaagctgctattagtgccagccaactgtagccacatgaaaaaagaaacctactgatttgatttcatttttcaaggaaagctagaaatcttggatttttcttttttgagacggagtctcactctgtcgcccatgctggaacgcagtggcgcaatcttggctcactgcaacctccgcctcctgcattcaagcgattctcttgcctcagtctcccaagtagctcggactacagatgggtgccaccatgcccagctaacttttttgtatttttagtagaggcggggtttcagcatgttggccaggatggtctcgatctcctgacctcatgatctgcccgcctcagcctcccagagtgctgggattacaggcataagccaccatgcccagccgaaatcttggatttttaaataaaatctgtctttaaaccagggaaactaattcattcacatataggtgtatgttcacacacacacacacacacacacacttacatgtatgtgtgagtattttttttaagcaaatactgtagcaaagataaaattggtccagatttggcttattataaagtatatggcaagtttccttaggacctatactttgaaaaaaaaacccttccttgggaagtgtggactaaagaaaaacaatgatgccccaaatatggcaaagagtgtgttaggttctcaggccaggtagcaacctgtatccacatcacacaccagtttctaaattgctttgcaaaccactaaagatcccattagtacccacaaatccctttgctgatatgtgactaaaaggtagagggggcagtagtaaagttaatggagagagacaagggagagggctaagggtttgcgtacatatgtgcatgtatatacacattgtcgaggagaggtggcagaagttatggatggagcaagcctggaccagtcggtggctggacagagcaggggacaggtgcccctgtgtgttctggccccagctaatttgggaaacagtctcacactggatggctcgaaggcgaggaatgatggtggggcttgcaggaggactggagcggctgttgataagactcttccttttatccatggtaggggaggcctgcaccgtgaacttgtgctggaaatctgcttggggaaagacaaacacgtgtatgcattaacatttcccataattaaattcatataagaaatatgacattcctcagcatccttgagggacaggccccagtttcctgaaaagctctttgttcacctgggaaatgttctcttttagaatcatctctttttcccaagggacatggggagatgaacgtataaaaagatggaaaattcactgtgcaagtgaacttcatctgtgagcttcataaagctgtctatataatgaatatagttcaagcagttatgtattaagaatagctgtttagctcatgagatgttgttgattattctaggaaatttaacttaaaattattggtttcacataatctattatcagatagatttggtcctcttttctcagggactgaagcagggacactgattcttctcactaagtgcaggcacagcagggtatcaatgactagcccttgtgggaacctagggcagtgagggagatggagcaaatggctccaattcggacacattccaaaggaagttacagtacagcataaagaatgtaaaacttacaggtctgaatttctgagtttcagtctcctcatctatcaaagaggtaaaataaacagctgctgcttgcacctatgtctccccattagactgtgatctccctgcaggtgggaactatagcttttctatctgcatcctgacatgcaacaatatgctgacacatgctagatgctcaaagggtgcttaaagagtccatgctgtctgaaaaggaaaaacaaatgtgcagcaaggggaccagcaaacacggctcataaacatattcactcaactgcatggaatgagttcccttatctgtacttaattaagccaccattttagtgcttaacatcatctactcctgccccattagaccattctttctttgttccttacactttttttttttgagatggagtttcactcttgttgcctaggctggagtacaagggcgcaatctccgcttactgcaacctccgcctcccaggttcaagcaattctcctgcctcagcctcttgagtagctgggattacaggcatgtaccaccatgcccggctaattttgtatttttaatagagacggggtatctgcatgttggtcaggctggtctcgaactcctgacctcagatgatccacccgcctcggcctcccaaagtgctgggattataggcatgagccattgcacctggcctgttccttacacttctaataagcctgctttctagggcctcatagacttagaacacagtgaatatctttatctacatcaacacacattttagcattcggctccctccatggatatattacacaccacaaagattctaattaatagtttcatatttctttatattttccccaaggctgcagtacaacaaatgcatgtttattcaactgatgtgtgtgtctgaaaggtcacatgtaaatcttatcatgtaaattctcatacattaaacccagtctcaactgcactcaggggactaattaaaaaaacgtcagccaggagtggtggctcacaactgtaatcccagcactttgggaggccaaggtgggtggatcacttgagggtgaaaccctgtctctactaaaaatacaaaaatcagctgggcgtggtggcatgcgcctgtaatcccagctgctcgggggcctggggcagcagaatcacttgaaccggggaggtggaggttgcagtgagccaagatcttgtcattgcactccagcctgggcaacaaaagcaaaactctgtctcaaaaaaaagaaaccttgagacaagttattttgcagagccaaaacttctcgtgtctcacacatgcacaccctggaatgttttcccccaacttcatgcttccttctccaggtttgcctaaagtgagatgtgcccctgtgagccaccaggcttctagcagcctggaccttgccgggttgtcctcacttcatattctgtgttcactcacatgcaacaatttccctggagtagggtagattttcaacatgccagtctttccagtgaacagaatggcccatttaaaacaggctggagtttgagccccagggtgtcatgtttccaagctcagtcccggactccctcaaaccctctgccacacgagttctttgccctgctcccacttcccagccagtccccggccactgaccagaagggaggctgatgcggttgccatccttgagcttcagccggctcttcctgaacttgcccttgcgtttcttcacccggggcttctcctggcacagctggtggatgatgatgttgagctcccgttccaggatgtcaatctcccgctcggccagctcctgctcccgacgccgcagcagttcctcctggttcttctgctgcagtgcagcccgcgtcagctcctcctcccaggtgcgaagttcctgcaggatgggcagaaccatcagagaaaagactggggtgctcagtgcagaggggctctggggtgaggcctgagagctcccagagggcttatggtgacctggagagctctcctatgatgctcagtgaagagagaggactcgatagctggtaaatgaacattagaccaccttgaatggtggggaaaggaaggctcagaacagccatactgacgggacagtcagagaagataaagccataggtcaagccctagaaatgggggctaagagtttctagtcgctccttccttcttcattaaaattgcctgtgatttatatatatttatatatatatatatatatatatataggtttgaatagaaaatataatcatgtatttatttacagacttggttgtactttactttctattttttgagacagcaactcattctgtcacccacgttggagtgcagcggtgcgatctcagcccactgcaacctctgcatccctgattcaagtgattttcatgtctcagccaccggagtagctgagattataggcatgtgccaccaaacctagctaatttttttgtattttagtagagattaggttttaccatgttggccaggctggtctcaaactcctggcatcaagtgatccatcggcctcagcctctcaaagtgctaggataacaggcgtgagtcactgcgacaagccaaattttttctattatataaaagatgttttttcaccaaatgcaatggcaacaaaagccaaaattaacaaatgggatctaattaaactaaagagcttctgcacagcaaaagaaactatcatcagagtgaataggcaacctacagaatgggagaaaactttgcaatctatccatctgacaaagggctaatatccagaatctacaaagaacttaaacaaatttacaagaaaaaaaaaaaccccatcaaaaagtgggtgaaggatatgaacagacacttctcaaaagaagacatttatgcagccaacaaacatatgaaagaaagctcatcaacactggtcactacagaattgcaaatcaaaaccacagtgagataccatctcacactagttagaatggtgatcagtaaaaagtcagaaaacaaagatgctggagaggatgtggagaaacaggaatgcttttacactgttggtgggagtgtaaattagttcaaccattgtggaagacagtgtggcaactcctcaaggatctagaactagaaataccatttgacccagcaatcccattactgggtatatacccaaaggattataaatcattctactataaagacacatgcacacgtatgtttattgcggcactattcacaatagcaaagacttggaaccaacccaaatgtccatcagtgatagactggataaagaaaatgtggcacatatataccatgatactatgcagccataaaaaaggatgagttcgtgtctttgcagggacgtggatgaagctggagaccatcattctcagtaaactaacacaagaacagaaaaccaaacacctcatgttctcactctaagtgggagttgaacaatgagaacgcatggacacagggaggggaacgtcacacaccctgtgggagtggggggctaggggagggagagcattaggaaaaatacctaatgtaggtgacaggttgatgggtgcagctaaccaccatggcacgtgtatgtaacaaaactgcacattctgcatatgtaccccagaacttaagagtataattaaaaataaataaatagtaaaaataaaaaaaaagatatttttaaagcagagccaacttaatccagcttaaaatgtatccactgtacataaatcatcctccaggtaacatctaacaataaaatataaatatgtttccagggtggctgctcaaaagctaagtgaggcatgtcatctaaatcttcatggtcacttgaggaatgaatccactgaggtatgtggtttcaactctcaccttatcttaaaggacaatgatttgctctagaagaatcacaaaagcatagcaaggaaaaaagagaacatttcctgaggtctttttcaggcacttgctctagaaccaaatttggctgctgctctatcacactcccctgaaacaaactgctcaatgagcacaggagatgtcaccccagagcagaccgtgcccctgcaaatctgaaggacagtcagtcacactgctagggggagagctgaagccagaaagctagagggtggaactgggacaaagtcccatttggaattgcatcttgtgacccaagaacaggcccttttgtcctgctctgagaatggaagcaggagccacatcagatggcagaacctcttccctacctcccctttatccttacgcatgagttcacaagtgagcccagcactgaattcctggcaagaggggaggggatatagaatcaggaaacaggaaagaaaacaaagcatgcctacaaaatttttaaatctagattttaaactcttaatgctggttaccctgggccttggattaaagtggggtgtggggtggaacctggagagagccatgtctgaaaaagcaggatatttcttcagtaaaggagccacagctacacttctgtggtcgaaacctaacttcttaatgaaatactcactataagtaaccattctggattaaaacaaaatagtgtagaaagggaacctggagctagaaaacaagcatgtgaacccatattggggaagctgagcagcaggtaaaagtggaagagaggaaagagatcaagaaatgaatacaatattctgatgctataaactctccattcagcttgtcttccatccccaggagaatgtcaaaatagccataaaagtgatagaaagaaggccggcatggtgtctcacgcctgtaatcccagcactttgggagtccgaggcaggcggatcacctgagattgggaatttgagaccagcctggccatgatagtgaaaccctgtctctactaaaaacataagaatcagctgggcatgttgacgtgcacctgtaatcccagctacttgggaggctgaggcaggagaattgcttgaacccgggaggtggaggttgcagtgagccgagatcatgccactgcactccggcctaggtgacagagcaagactctgtctcaaaaaaaaaaaaagtgatagaaaagaaatgagaaaagaattagcacattgaaaagtgtctagcatgtggtaggcctaggtactcagtggttgaataactattgagtcaataaatgaatgaagagaaataataataggagatagagtgcaatattgtgaatgcaatccttctttatgggaacatagatttatcacaagttcctgagagttgaacttgaactacttcttccttgatgaaataaacctcaaattaattgttgtgcgccctccaaatcctttgtttctctgtcctatgactttgttttcattaccaagagaagaaaaattcatggaagatgcagaaaaaatattcctggttggttgattttgctgttaagtgtaaaagtttaaaaatcaaagctaatttcaagcttcctaagccctcgtctcctccatgctcttgtctaagggatggtctggctctaagtcactctctttaatggaacacaaaccccagatgacaccaatgcattctcacaataatacttagaaacagtaggttgatccaacctgaggaattagctgaatcatagggtaaatgaggaaacttgtggaatatatgcctatgacaccattcacctggaggacccttagacatgttgaatctcctacttttgcaacacctatttgtgttgcacagtttgcaaatcacatcttccacatacagaatgagttaagaagaatctctccagagagaaagcacatcttactctcacttaccaaacaacaagccttataacagggaggcatcatagcatggtggctaagagaaaggactctggaacaaactgcctgttcaggtcccagcttcaccatcattaactgtgtggtcttggacaagttaataagggcatcacatgtaatatggagttaatagcactgacatcattgacacagacaattattatctcattaaataagataattcatagaaagtataagaaagcatggcacatagcacatgctctacaaatgttagctattatgagtttgacttcctagtaactacttactgacaaaatccaaacttcatttttcttactggctggtacccttataatttcatcaattaaaagaaaggtaaccaagggtcagtgatgcagcaatcaaaaaaacaaaaggccagcaactcttgggattcttctagctggaatactatttagtgagaggaacagtcttttgtaatcattctgctcaacagccagtgcaagtccacccaccagggaccctaaagagtcattgtaagctcactccattcttctagagaatgctcattgacttggcaaacagtactgtgttcagaattgctatgttccataaaaagagtttaattcttcaaatcagctccagaaattatttgtaagtcatttgtgtagaataaaaatgacacttgatatggtttgactgtatcttcacctaaatctcatcttgaattgtagtttccataatccccatgggtcatgggagggaccaagtggagataattgaatcatgggggtggttccctcatcctgttctcgtaatagtgagttagttctcacgagatctgatggttttacaaggggcttctccctttgctgggcacttatttcttcttcctgccaccatgtgaagaaggacctgtttgctaccatgattataagtttcctgaggcctctccagccctgtgcaactgtgagttgattaaacctttttcctttataaattaaccagtgttgggtatgtctttattagcagcatgagaatagactaatataatattacaacgaatatcggtttttggaatcagaagacccacattcaagattctgcttccccacttactaactctgttacttcaggcaagttgctgaccctcagctctgagatggaaacaataataacacctggcctacatactgatggcaggagccataggactcctggataaaacagacaaaaaggtctcatcaaatttttcaagtggaaaaagtgggaaaccataaagccataaacaattttagctatcattattatcacatggctattaacttcccaaattcccatagtgcagagtgagaaaagaaaaaaggcctgtaatcccagccctttgggaggccgaggtgggcggatcacgaggtcaggagatcgagagcattctggctaacacggtgaaaccccatctcaactaaaaatacaagaaattagccgggcgaggtggcgggcgcctgtagtcccagctactcgggaggctgaggcaggagaatggcgtgaacccagaggcagagcctgcagtgagctgagatcgtgccactgcacttcagcctgggcgacagagcgagactgtctcaaaaaaaaaaaaaaaatggtaaaagaaattaaccaaatctataaagacttctctcttgcccctagctacatcccttagatttagtcctgcccctatataagcaatatagttgcatgtgactggcttcacctgtgtgtacactgactgctagggacacactgagggaacagaaaggggccatttagggaatggccaccaaaacaaaaaagcagatctctggtaggctaggagtctctgaactccctggttggtttgggcttgaaatacttttcataaaaacatgaaaaatgccacacaatttcagacccatgttattttttgcccatattctatttctgattctgatgtcaaaagacatgggaaggatgttctgataactatcctcaaggttgaagtatccctatatcaaattaaccttcttctagaagtctattgtagaatcaagaaacatttccagaacttctcatatttccagctggcagggtgagacattccactgtgagaaaagaaaaaaggcctgtaatccaagcactgggattttgcccaactgcattcttctctggtttggacaattaagtagataccaagctggaaggtgggcatgctagaatcaagatggtcagtcagactcggtccagaggtccctgtgagtgaggtctaccaattcaatgcatgccttttttcttttcgttcgtttttttgttgttttttttgttttgtttaccttttctttggccctgagttggtcaaacatctcctgaatctcgtgtttccagttgtcctgcaggcagtggaaggagtccttgggcatttcaaagaaaccagactcctctatggtggttagctggtccaggatattcgtgaaagatggtcgtgagtggggatcaggattccagcagtctgaatagaacatgtgaatactcagaaagcatgaatggacagaagcaaacatgtaagacttaggctattacatggcctcacttcccagaaaactacctcttacttcttccagaaacagagatcagaatttaggtaacctcaaataaggctcaggaagtaaagcaaactgtccaccattacaaccataaagagtgaaaatggaaatgaaatgcagcagttctgtactcattccattctggctgttaattaaggataagaaaagcgagcccaaagagttttcttgtacaaagcaccaccacaacacaatttaccatgttactacctgattcaagaacagacaatggggaattatgccctgggcttcagtttcccataaataaatgaattagccttcccccacccacaatgggatgatgaggaggcgaggatgaaaagcattctagtgggagtcagggaaatcgaattctacctaatcccagctcagccactctctaatgaggtggccacctatccactcaacttcgcttagctttagattccttacttacaaaattatggggtttgactagatgacttttagagttctttctcctaagatgttcttcacgtctcttaaggtattcagaggtcctgacataaaagttgctgtactttctgattttgcattaaatgataatatgctgaagtgccggatagcaggcttttgttactaatttcacttctacagtccctggagatatgactgcttgcagcagggtgtggatgtcatcttgaagaagcctttccagttgcccagaggattcctccttaggtgactgaaactttatctcctctttcagtaactgatctcacagaattggccaaactctacccagtgcttacaagaggcaaagtgtctccagtttggttcaggccagggcttacttaccttccatgagtttggcaaaaggttctgggcacgtagaaggaataggaagggcgagtttgttcatggccactccataagcgactgctaagccatcaatgcctcgaaagggcacctcaccagtcagcaactcccaaagtagcaccccatagctaaggagaggaagaagacagaagccatgtaataaacttcaggtacaacttcactgcaatagctcgagtcttttctgagcatcccacattctccccaacagatagtgagactaatgaaacagaaatactaatgtgatataaaagggaaaccataaagcctactagctaaaagcaaaatctctggagtcaagcatacttggttttcaagttttctcccataattccttagctatatgaccttgggcaaggcactacacctctttaagcctctaattcctcatctgtaatgcacgaataacactatcagtctggcaaggctattgttgaattaaatgagctactatagtgtttaaataagtgcccaatggccatagctctttcactatcattattgttttttgtttgtttgtttgtttgttttgggatggagtttcgctcggttgctcaggctggagtgcagtggcgtgatctcggctcactgcaacctccatctcctgggttcaagagattctcctgcctccacctgccgagtagctgggattacaggcatgcaccaccacgcccggctaatttttgtatttttagtagagacagggtttcaccacactggccaggctggtctctcaaactcctgacctcctgtgatcctcccgcctcggcctctcaaagtgctgagattataggcgtgagccaccacacctggcctgttatcattattattaatgaaataaactgggagaagaggcagcctcccaagtataattttttttctgttttaagaaaacttcagcttttgtcacagatacattttttcccccaaagtgctaggattaacagattttctttttagctttacaaaaagcagagtgctaaccactcaaagcagattttgttcctataaaagatttctttaaatgcccactaggttgaatagatttctgcccccagatcagcgtgagtgggttcttaacggagatctctaattcaaatggaaaagtttcacaagggtagaccacatcggtagaacagagcagcgcatcagctgtgagaacttcagtgtgccctccctatctttcaagtccacataaagaatttcttttctcgtgtcctgtgagtcagtgaatgtggagtacaaagcttaatggaagaattattctgtgaattcacgatcagaaccagacacaatcacacagcactcagtccttccaggaataagtcaggacaagaaaccataaggctatgaatagttagaagaatggctctccttatgttttcaacaccaaattcaacaataagttttgcaaccagcaacaaaggtcatattaatttaaaaaataataataggccaggcatggtggctcacatctgtaatcccagactgtaaattcagcctttgggaggcggaagcaggcagatcacttgaggtcaggagttcaagaccagcctggccaacatggtggaactccatctctactaaaaatacaaaaattagccaggtgtggtggtgcatgcctgtaatcccagctacttgggaggctgaggcaggatgatcacttgaatctaggaggcgaaggttgcagtaagccaagatcacgccactgcactctagcctgggtgacagagcaagactctgtctcaaagtaatcaataataataataaacccagtagctatttatcatgaaaccttatatatgaagaccactaagacactttacaaacatcactgtgaatctctacaacaattctgataggtattatcaacattttgcacacaaggaaagcaagttttagacatgtttaggagcatattactaagggcatacacagagtacatcatggtgggcccagaccagttctcaatttattccccctagaatgccttctaccatttctttgcttggtaaatgctaatcatctttcaagatccaactcaaatgtcccaccatttattcattcatcagatgacggctttaccccagtgaggccttcaaatactatcattttctttatgcatcttgccaggaaaaaacaaaaagcctggtagccagttggtcttgactcgtctagacaggagatggattttagtttggaggcttatgggaatagcattggatactttacgatgccttcttgacatccccagatgttactcagcccatttgggctgccatgtattgtagctgtttgtctgctagcctataggctcctaaagagcagggagaaatgtttttaatctttgcattctcaggacctagcccaagctctggtacacaggaagcactcatagatatgtgagtgagtgggtctgtgggtatgggagtgagcgcatggtcagacagtcctgcaggctgccctgggtcctctagaggaaaacccaaacatcatcaagaattgcactattacacttcctgacaaacctttcatgtgacttatccaggtagtggtcatgctggggagcttctaccaagtgacctccaggaactctcagcattgccaaccagattcctaggtcaaagccactgttatcctccattgcttgctcttggaataaatgcccacctccatcctggagaataaaaaccaaaggtcccacagaacccctttctcccaaccagacaaagacagacggtatctgggccctaactacctggaaagatcatagagtgtttcaaagatccaaatatgttctgtttgtgtccctgcatcccttctgtgacagttttcacactaagctctcagtgtcctgtgaaggtgtctcagaccgcctggaagcatgtcgggggtgaggcaggggtggggggttatgggactgggactggccccattagctccagtcagggcagctctgctcttacctggcttgtttctttgtttgtctgcattctatcccacttcaggggttctacagctaaaaggaatgtgagaactactgcccaagtaggcagaatgctaccagagaaagatttagacagacttgggtcaaatgcctgttttatcacttaacagctatgtgcctttaggaagcaagttcacctctccaaacctcagtttcctcatccctacagcaaagacagcaataccgaccttacagaagagttacaaggaatcactaacaccaacaactaaccctcatccagaaattaccatctatggctagtagacctgtggtttctccaaaagggcctgaaatgagattgtgtctgaggaggcttatgtagagctacagtgttggtgagagctttgctgagggacactggcattcagagaagaagtctttctggggctgactaaactagttttcctctgccaacatcccgctttatgtttacaatggaaggtgggtgatataaatgaagacttggtattctgttggtgggaaaaaagactggagaaattcaagagaaatacaagtttacgtggatctgagctcagggaaaggcgggcagtagaagttgatgtgatttacctcaggtttagtcaacttagttgccctcccaaggttaaaaggtcaacaagtcctttgatgaccatttgcaagcagcctggaagaactcgttcagctaagtcactgcctctgagtacctccccgcaacacagacccaccagctcccacagtgctgccagtaatttcctaaaagtcctcactgcctaacccaaccctcacaaaatttactcttgagttaataattaaccacctcccgaggcttggtaatcccttcaaccatttcctaggatcagaggtggaggaggggtgtttgatttttttttcaaagtgaggaaaagtggacagctacctttcttgacaaaaggcacagcaactccatgcctgtgctgggccagagctctattttgtagtaacctgcaccatctctagactgtcaggtcagggtccatgctctgaaaggaggtgaccagtctcccttgaatgaggtgggctggggaatgtcttgcacttggtaattatctatgattccacattccaggaaccacactgactgtttaataatctttgacaaagataattgaactaatatatgtgaaagcactttgtaaattgaaagtagcatataattcttcttcttattaactgaaccctcattcaaaatgatgatgtatttattaacatatatgtaatatatacattgataaacttattgacataacaacatatttattaatgtggttatgtgttcatgctatattacattcaaaaagcaacttttaaaacagaaagatcccactagggataggcagatgagcacatgaataggagtaaacacacccaaatatcaatacgcattatctctataagtgggttcagggtgattttctttccctatcttttctttcttgtttacccatattttcaaattttttctacagaaaacgttttgctattgtaattttgagacagagtcttgctctgtcgcccaggctggagtgcagtggtgcgatctcagctcactgcaagctccacctcccgggttcacaccattctcccgcctcagcctcaggagtagctgggactacaggcacccagcaccatgcccggctaattttttgtatttttagtagagatggggtttcaccatgttagccaggatggtctcgatctcctgaccttgtgatctgcccgcctcagcctcccaaagtgctgagattacaggtgtaagccaccgtgcccagccactattgtaattttttaaacttaaaatgattaagacaatgcctccacctcatcccacaaccaacaggcaagaaggccttgtgggacgatgccctctgacagtaaccactgctctacccacacagcgcaaagaaagggaacaatttcagcaatagccttcttgaggcagtccccaatccaagcagactgggaaacttacacaattgaggatccagccctttatcatctcaccctccatcacaacatttgcaggagaactttagaagcacactcaaagagcaggaagacaaaccagatggccctgggcacctggaatagcagaggcgcagaggcccccagctctggatgagttccaggagggttgaggtgtggggcactcagactcagccagtacctggcatagggcaagcattccacagacacttcttgaatgagtcagtgagttacaagtcagtttgggaaacagctttgtaccaagttcctaggcatgccctggccctccctgagacaccctgctgggccctaggcacgcacggtgggctgatcattcagaagaggctgccttaagtgcaggaacaggaccatacagatggtggcataactacaagcacagattgtcactacacacatatctagttctaatcatagctttatgtctgccacctgggtgaacttaggcatgtgacttcaattgtctgagcccagttacctcatctgtaaaatggaaatgatgatccctactttggggaattcttgtgaagactatagaagatgtataacatttaccacagaccctagcccttaagcatttgtaggtggtaacaactgttaccagtgtacaagcattgctgtatgtacagcagtgggcacacattttcctctgctaaaggtgagagaccatttggagctacttagatgggtaagcctgaggaagaaggaatgaaaggcccatttaatgggttataaattgtgctttgaaggaaatcctgcagcatagaagctaagacagctgaaagggagcagggtgaattatgttttcaaaccacaatcatcaaccaaactgggtcaggaggcttaagtcctgggaacaagtctagactagagcaactagagacctgctggcagaccatgtgacaatatccaagacacatcatccaaagtgcttctgatttgaggtttacctccaagtgatttcctctagagagtagaataatttcatcagatgcctctcaccagaggctcttccttcaagcctgcttttaggatcatggttatagggcaagacctagaggttagtcttacaacaaggatacttagggtaaaagttgaaaggtcctgcccttgttctttcggtggagaaaaaagctctgcaatggccttgtctttccctgtctacaatttctgtcatcctgagaagactctacatgcggcatttgtgctttcccttcccactgggaaggtacgaaggtacttggatacatgacacaactctgtccaaatcgtcaccagcagaaacctctggagtgtgtgacagtaaaacctgagcaatttcagggttaggctgggagaagaaacctagtgggaatactggaggtagaaaacaatcatgttactgagaaatcatggttttccattaaaaaaggcaagagagagttgagtgtgacaagtggctgcttgtcccctcaaatccacccttcctgtcttccatagtggggcacacagttgtccagctagaacgtacatttttctgcctcccttggagccaggtgtgcccacataaccaagtgcaggcaattgggtgtgcagagatgtgtacaacttctggatagtttccaaattaaagataaactgcgcttgccatgagtaagttctccttcctcttttatgaaaattgtaatacacacataacagtcacccaatttaaccattcggtcaaggtcaatgcactgagggaatctaaaagaacctaggttcctaaacgatctcatggggcacagttgccctgctagcctgggctatttagctagtttttgaaagagaatatgcttctatcctatctaagcctccatatctgtatgcctctttgtaatagcagcttagcttaattgatgtattaatctcattagcatatggtcaagcaataaaagtgttaaactgaaacatgaaattgctgattttatatatcaaaaatagttgaatatcagtatacaactcaacttaatgagatcaggtcagatattttaaggaaagttaaactcatttcttctcattagctactttaccctgtaattaatgcatggtaaaatgaggttcaatatacagatgctacaaaacatcactgaaagaagttaaaggaggtctaaataaatggaaagatatcccatgatcatgaattggaagacttattaagatgtcaatagggccaggcgcagtggctcacatctctaatcctagcactttgggagaccaaggcaggtgaacagcttgagctcaggagttcaagactagcctgggcaacatggtgaaaccctgtctctacaaaaaaaatagaaaaagtggagcatgcctgtagctccagccacttaggaggctgaggaaagaggatcacctgagcccaggaggtcaaggctgtagtaagccatgattacaccactgcactccagctcaagcaattgagaccctgtccgaaaaaaaaaaaaaaaaagggtgtaaataatctacaaagctacagatttgatgcaattcctatcaaaatcccagctatctattttgtataaattaacaaaattaccctaagattcattaaatgcaaaggactcagaatggccaaaacaatcttcaaagagaagaacaaaattggaatcacatttcctaatttcaaaacttaccacaaagtcatactaattaagaaagggtggtattggcataaggacagatatagattaatggagtagaactgagaatctagaaataaacctttatatttctggtaaattgacatttgataaaagtgaccaaataattcgatgggaaaaaatggtcttttcaataaatggggccaggataactgaatagccacatgaaaaataataaagttggacccctacctcataccacatacaaaaattaagtcaaaatggatcagagacataaaagtaagagctaagattataaaactcttagaaaaaaatataggagtgtaagtcttcatgactttggactaggcaatgttttttagatatgacaccaaaagcacaatccacagatgataaaataaactagacatcatcaaaattaaaaacactgtttcaaagaacagccttaagaaagtggaaaaacaatctacagaatggaaaaaaaaatttgctaatcatatatctgatgagagaatagaaaggactctttcagctcaacaataaaaagacaaatactctaatttttaaattggcaaaggatttgaatagatatttcttcaggttcagagatataattggccaataattacatgaaaagatactcaacatcataagtcatttagtgaaatgcaaatcaaaatcacaacaaaatactatttcatatccacaaggatagacataataataactttttttttaaaaaaaggcaataacaagtattgaaaagatgtggtgaaattggaacattcatacattgctaacgggaatataataaaatggtatagctatgatgaaaaagtttggtggttcctcaaaaagttaaacatagaactgttacatgattcagcaattccactcctagggatagacccaagaaaactgaaaaaaatatgtttacacaaaagcttgtgttgtacacaagtgtccatagcagcattatttataacagccaaaaagcaaaaacaacccaaatgcccatcaactgataaatggataaacaaatgtggtctatccatacaatggaatattattaagccttaaaaaggaatgaaattctgagataagttacaacatggatgaatcttttttttttttttgagacggagtttcactcgtttcccaggctggagtgcaatggcacaatcctggctcactgcaacctctgcctcctgggttcaagcgattctcctgcctcagtctcccgagtagctgggattacaggcatgcgccaccacgcctagctaattttgtattacaacatggatgaatcttgaaaacattatgctaaatgaaagaagcctagtcacaaaagaccacaaatggtatgattccatttatgtgaaacatccagaacaggcaaattcataaagacagaaaggaaattagtgtttgctagggagtagaagggggaaggattagggaaggactgataatagacatggagcttcttttttggatgataaaaatgttctggaaattggccgggcatggtgtggttcatgcctatgatcccagccccttaagaggccgaggtgggcagattgctttggatcagttcaagaccagcctggtcaacatggtgaaatcccgtctctactaaaaatataaaaattagccaggtgtggtgcacgcctataatcccagctacttgggaggctgaggcaggagaatcacttgaacccgggaggcagaggtggcagtgggctgagatcatgccactgcactccagcctgggcaacagagtaagactccatctcaaaaaaataaataaataaaaataaagttctggaaatagatagtggttgtaatgggctgaatggtggccctaaaaagctatatctatgtcccaatacccagaatccttatttgagtcattatcttcactagagtctctggagggtgtggccctgcccacatcactttcaggcttctggcctcaggaactataaaagcacgcacttctgttgctttaagccactaggtttagtaatttgctacagcagccctaggaaactaataacaatggtgacccatacacaccttttaaatatactaaaaaccactgacttacatgcttatttacttcttgagacagggtctctctctgtcacccaggctgaagtgcagtggtgcaatcacagctcactgtagcctcaacctctcaggctcaagtaatcctcccatctcagcctcccacgtagctgggactacaggtgcatgccaccacacctggatactttttaaactttttgtagagatgggggtctcgctatgttgcccaggctggtcccaaactcccaagccccagagttctttccaccttaccctcccaaagtcctgggattacaggcatgagccactgtatccagccaacttatacattctaaagtgtacaaaggattagctttacggtatgtgaataatagctcaataaagctattatttaaaataaacgtgcacacacacacacacacacacacacacacacatacacagctcactttacaacacatcaggacaataactccatggactgatatataatgataaactacagtcctttcttttgtatactaaggtgatgctactgtcccacagccatgacaacatatactaggtagttgctcatccttcctcagctgggaaaaattttagatctatttccttgcaaccttttgggctcacatttactaggaggatggctggtcatttctagtctgcggctttgcagttctgggcacatatttgggacccatttttttctgatttctggatcaatgtcaacagatagagccttgactaaaagatgaactagataactggaaaaggtaatttttaggccatcaagaaaaacgagattgcacaaagaacattcattggctcaggagctttagagtgaggacattgggttaatcccctccccaagttcagcagtaacagccacgaaagcctagcattgctgagcaagccagactgatcctcacgaagctctccgagaaggaccgagtgtccttcccatcttacagcgtagagatgggagtacatgttgcccctggaatctactggcctttcctagggagcaatcaccagcaaaaagtggcctgcgtatagcacttcagggatttttttggtagatgaaagcattagaaactgtcccctggcaatatgggaattggcatagatgactcttgggggaggtcacttagacctacttcaggtgcctgggatcctaggtaacctcaattctccaagtcttgaaatgtgtgtgccaccaagatggacctaggaaatgctgtccctgcccccctggaccttacctccacacatcactgcctttggaaaacatggaggcccggatgacttcgggtgccatccaagcatacgtccctgccgcactcatcttggtggttcggtgccattcccgagccaggccaaaatcagtgatcttcagaatcttgttgctcaggtctccattctccaccttctggaggatcaatactaggcaaggaaaagaatacagaagaaaccagagtctgcattaatcacagggaaaccacagaacagaactcttctgccatcctcctggcctctcctgtgggctccagcatttagctgccatggattgatggtcagagccatcatttcttaaacacctacagtgcatccatttttgtaccacccattttatagccactatctctaatcctcacaacaacttacaaggcaggtactattgccatctcagttttactgatgaagaaactaaaatacacatgtcacaattaaataaattcctggctgggcacagtggttcacgcatgtaatcccagcatttggggaggccgagacgggtggatcacctgagattaggagtttgacacctgcctggccaacatggtgaaatcccgtctctactaaaaatacaaaaaattagctaggtgtggtagtgcacgccagtgactctcaataatcatgtcctcaaataccggtatctaccaagcacccgttgctactaatcattaaagcaccaaagcttgtgaaagccttattttattttttgtagaccttttttttgggctgaaatccacataacataaaattaaccatttcaaagtgaacaatttagtgatattgtgtacattcacaatgttgtacaactaccacctgtctagttccaaaacattttcaccaccccaaaaggaaaccctgtacccattaagcaattattccccattctccctcctcccaaaccttagcaatcaccaatgtcctttgtctttataaatttacctagtctgaatacttcatgtaaatacaatcatacaatatgtgacacacctgcttatttcactgaacatgttttcaagttcatccacattatagcttatatcagtacttcattcctctttatgggtgaataatattccactgtatgtacatattacagtttatccttttgtccactgatagacacatgggttgtttccactttctggctactgtgactagtgtgtatgaacatgtgtatacatatatttgtatacttgttgtcatttggggggtacagatctaggagcatatttgctggatcgcatggtaattcgtgtttatcttttgaaggaaccaccaaattgttctgcacagcagaagaaccattttacatttccacaagcagactatgggggtttcaatttctccacatcctcacgaatacttgttattttccttattattggtattcttaatgccatcctagtgcatgtgatatggtaactcattgtggtttgggtttgcatttccctgatgactaatgatattgaacatctatcttctcatgagtttgttgtccatttgtgtatcttctttggagaaatgtccactcaatcctttgcccatttttaaagtaagtggtttgtctttttattattgagttataagagctcttcatatattctgatactagacccttatcagatacatgacttgcaaatatttctcccattctactggctgtcttctcccttacttgatacttttgatacaccaaagtttttaatttagatgaagtccactttatttttttatttattgcacatacttttggtataatatctaagaatcattaacacattcaagatcatgaagatttaattctatgttttcttccaaaagttttatggtttcagctcttacatttaggtcattgatccacttttaatttctgcatataacaggggtcgaatttcattcttttgcatgtggctatgcagttgtcgcagccccatttgtttaaagaggaaagctttaaaacacaaacagaggggagagctgttatctcccaacatgctttcctgagtggaagagaaaggttatattcacagcagtttacatatttgtaccactgcagtaagcccactgtaaacttctaccactgacaaacagctgtggcaataacaaactgtcatgctttcacatcttgaaaaatgtaagaatgttttatcaaattttggtgaagtccataagagtgcattgtgtaaacctcacctctcctgtcgagcaatggcaaaaacagtcatgcaccgcataatgacgtttcagtcaatgacaggccaaaaccatgatggtggtaccataaggtaataatagggctaaaaacttcctatcacctagtgatgatggcagctgtcataatgtcatggcaccatgtattctcatgtgtctgtggtgatgctgctgtaaacaaacctactgtgcaggcagtcgtataacagcatagcatatacaattatgtaccatacataatacctgataatgctaataagcgactatgttactggtttatgtatttactttttttttttttggacccaaggtctcactctgtcattcaggctggtgtgcagtggtgcaatcatagcttattgcagcctcaatctcctgggctcaagtgattctcccacctcagcctcctgagtagctgtgactataggtatgtgccaccacacccaactaattattttagtttttgtagagaagtgggtctcacttcattgtccaggctggtctcaagctcctcggttcaagcgatcctcccacctcagcctcccaaagtgttgggattactggtgggagccactgtgcctggccagcatactatactttttaatcattattttagagtgcactccttctacttatgtaaaaaaaagttaactgtcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagctgggcgcggtggcgggcgcttgtagacccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaagttaactgtaaaacggcatcaggcaggttcttcaggaagtattccagaagaaggcattgttattataggagattaacagctccaggtgtgttttgccccttccagaggaacaagatgtagaggtggaagactgtgatatgatcttgaccctgtgtagaccaaagctaaaatgtgtttgtgtcttagtttttaacaaaaaagtttaaaatgtaaaaacaacaacaacaaaaaatgtatgttaaaaaaaataatgtaggctgatgtttcttctggaacctatgccatgtcccctttaggaaccaagcacaggaccaggctctttaaaaaaaaaaaaatgtaggctgagggtggtggctcatgcctgtaatcccagcactttgggaggtcaaggtgggaggatcgtttgagcccaggagctggagaccagcctggaaaacatagtgaaaccttgtctctacaaagaaattgaaaaattagccaggtgtggtggtgcatgcctgtagtcccagctactcaggaggctgaggtaggaggatcacttgagcctgggaagtcaaagctgcagtgagctgtgattgtaccactgtacttcagtttgggtggcagagtgagtgagacctctctctcaaaaacaaacaaacaacaaaaaaaaagtaaatagaaaaaagctcatagaataaggataaaagaaagaaaatgtttttgtaaagctgtacagtgtgtttatgttaagctccattgttacaaaagagttaagaagtaaacagtttttgtttataaagttaaaaagttacagtaagctaagattaatttattattgaagaaagaaaatttttcagctgggcgccatggctcaggcctgcaatcccagcactttgtgaggccgaggcaggaggatcacttgaagtcagcagttcaagaccagcctggccaacatagcaaaaacccatctctactaaaaatacataaaattagctgggtgtggtggtccgtgcctgtactcccagctactcaggaggctgaggcagaagaattgcttgaacttgggaagcagaggttgcagtgagccacgattgcaccactgcactccagcctgggtgacagagtgagactccgtctaaaaaaaagttttctttataaatttagtgtagcctaagtgtacagtgtttataaggtctatggtggtatacagtaatgtcctaggtcttcacattcactcaccactcactcacccagggcaacttccagtcctgtaagctccatttcatggtgagtgttctgtaaagaagtaccattttttatttttatatcatatttttactgtaccttttctacgtatagatacatttaggtacacaaagtcttagcactgcattacaattgtctacaatattcagtacagtaacatgtacacgtttgtagcctggaaacagcagactacaccaggggtgtccaatctttcggcttccctgggccatattggaagaaatgtcttgggccacacataaaatacaccaacaacagctaaaaaaaaaaaaaaacaaaaaaaaacaaaaaaaaaaaaacaaaggaaaaagtgtcctgagccatagcgggacaagcttgggctacaccatatagcccaggtgtgtagtataagtacactctgatgttcgcacgatgatgaaattgcctaatgatgcatttctcagaatgtatccctgccattaagtgatgtgtgactgtaccgagaagaactaacgagtctaggcgtaagtcaatgggggcctggccaggcagtggaacagaaaggaaaagatacattggaactaaagacccagtgattaaccagatgtaggggcctgatggagaaggaagacatctccagcctttcaggtttgggtgacaagcagaagaatggtggtgcccctaattgggaagttgagagaaaaagcccatttgaagaagccaagtttagttttggacataatgggtctaggttcactgtaacaagagtcagtatggaacaggaaaagagcagataatttaaatcctaggcttgacactcttaatgtgaccctggacaaatctcttaaactttgtacctcaattcctgcttctacaaaatggggataaagattaaaggcgatacagcaataaagcaactagcagagtacctggcacttggagcactatagttattattataattaggtatcctgtacataaatggaaaccatagggttcagcgctcaagggactgatatggaaggcctggcagtccctgacacacaataaccacgcaatacatttttgctgtatagataaatggaatgcttgattaataatgacacctactcattatgggtcacttactacgtagcagcacgatgctgtttatgtccatcacttttgttaatccttaaatcacccctcagcagtaggtgtaattattttccccattttatgcactccaaaccagacacagaaaggttaagtcagttgcccagtcagtgagggatggggaagggaatcaaatccagatctgtctgacttcagaaccacattcttcacctttgtgccatgccgtacagaggccagaaagaaatcctatgtgtctttaagccctgcctccatttctgcctaatccctaaagctgtaattgattagtctaccctgcacttctttttcctgaattcttccttcagcatccaaataccacataatctaacactatatgcacttctaatcactcctgactgctgcatatatatgggtgtcatcatttccgctagcatgtgatacagtatgactcctagaaagcaaaaacctcattctttttcttctggaacctatgccatgtcccctttaggaaccaagcacaggaccaggctctttgaaagaactcatcccggctgggtgcggtggctcatgcctataatctcagcactttaggaggctgaggtgggcgggtcacctgaggtcagcagttcaagacgagactggccaacatagcaaaaccctgtctctactaaaaatacaaaaattagctgggcatggtggcacacacttgtagtcccagctacttggaaggctgaggcaggagaatttcttgaacccatgaggcggaggttgaagtgagccgagactgcgccactgcactccagcctgggcaacagagtgacactcagtctcaaaaaaaaaaaaaaaaaaaaaaaagaactcatctcttgctggtcacatacttgaccaatgggatatctgtgcatcttctcaaactatccactttcccatcttattgttgccaggtattggggtagggggtggaggggcactgggaggagactagagaaagagtaatacctcagccaggggttcaccagtgactaacacacccagttagtgccaggtcgggtaggggacacacagagaaagataacctgaagactctcagcttatctcaacggcctttcgccttctataaggaaagacaatgtgacaaaagtgagtatcaggtcaagacagggtctcactctgttgcccagaatggagtgcagtggcacaatcatagctcactgtaaccttgaactactgggctcaagcgtttctccacctcagcattccgagtagctaggactacaggtgcgcaccaccaaccccagctaattttttattttttgtattgaccggttggtcttgaacgcctggtctcaagcaatcctcctgccttggcttcccaaacactggaattacagaagtgagccactgtgcctggcacaaagacatcattcttgattatttcccaattaggacaccacctatatataccacttaatattattatttaaataatatttaatgggcatcaaaaaatagaaagaataagacctagtatttgatagcacaacagggtgactatagtcaaaataatttaattgtacatttaaaaataactaaagtataattgagctgcttgtaacacaaaggataaacgcttgaggggatggatatcccattttccatgatgtgattattatgcatcatatgcctgtatcacaatatctcatgtaccccaaaaatatatacacctattatgtacccacaaaaattaaaaattaaaaaaaaatttaaagaagaaattctatatcactattgtaaatgggaaagccaaaaattctcctaacattgagtaacctgtacaaacaaataaaatgaaacaaaaataaatggtacagtggcagacccgcatatggtcaaaatgctgagcctaaggcctgccttctctgcttgagaagaaagatttgaagtgttagagaggaattacagacaaacagcaccaaaatgaatgttgatcctccatttacacaaaaaagctgaatgactttctttgggattcaatgttgcttaatgcagaccacttaaaatggtctcaaggccatcccattaggaggtcagcaggagaaatcgggggtgtcttgccactaagggatttgtgaatctgacctaatatcatttagctgaggccaggctctcaaaacttggcatcactgaggagactctcccattaggtcctaatggtaaacttagctttggttgatgatctatgtcattttcagatttcttatttattattcatctccattagtacaagaggcttcaatttgctaaatgctcaccttggtgccaaggctcatgtcctcaggcctgcatttggttcagatgattcaatgccatctctcctacattacgtaactcagctaatttggttttgagggttatgttttgttttattttttaaagtttattgttaaacgtattatacacataggagagtacattaaaatgtatacatgtaacatgtacaaatgtatatatggctgggagtggtggagcacacccgtagtcccagctacttgggaggctgaggcaggagaatggcttgagcccaggaattcaaggctatagcaccaccatgtttgtgcctgtgaacagccactgcactccaatctgggcaacacagtgaaactccatttctaaaatttaaaaatgtatatatggtttaaagaacataatatgaaaacccacataatcccatccggtccctttagaagttccatgtgtctctctccaccaccccctttcctctctccctaaacatctgacaaccgtgacttctgttattcatttctttacttctctttatgattttaccagctatgtacacatctctaaataagataatgtttagttttgaaaaagtgagtggcaaacaaaaaatgaagctgtgtgttgtagcctcctagggctgccataacaaattaacagaaactgggtggctcaaaacaatagaaattattctctcacagttctggaggttagaagtccaaaatcaaggtgtcggcagggccatctcccttcaaaggttccagggaaggatccttctttgacccttctagcttctagcagttgccagtagtttttagtgtcccttggctcgtagcagcgttaagtctaatctctgcctccatcttcacatggccatcttccctttgtgtatctgtctgcatcttcacctaacattctcctatttgtctatgtgtccttataaggacatcggtcattggattagggcccatcctaatccagtatgacctcatcttaacttgactacatctgcaaagatggtatttccaaatttcacaggttaggacttcaacttattgtttgtgtggagggttgtgggggacactattctacccacaacaccatggaggagtaaaaatactgcctttgctaaatgaagccttcccaaagggaataagctaaacagagtctctgggaaattcccatggaatttacaagagcccttcctgggaaagttgataggcaagatcatgaacaagtcctggaaacacagggcaggtaaccacagtgggaacacctggtggtaggggtcaaggtaattgcgagagtgggactcttctgtattttctgtttcttttgtttgtttgtttttgagtctcaatctgtcacccagactggagtgcaatggcataatcttggctcactgcaacctccacttcctgggttcaagcgattctcctgcctcggcctcccatgtagctgggattacaggcacacaccaggacgcccagatacttttttttttatttttagtagagacggggttttaccatgttggccaggctggtctcgaactcctgacatcaagtgatccgcctgcctcggcctcccaaagtgctgggattacaggagtgagccaccgtgcctggctcatattttctgtttctaaattcacatggacctacctttagcatcgagggttgggcaaagaaaacacttctgttaatataaaatgcgtctatccatcagcagggcaaggaggggcgacagaagcttcatcagcacatgagcaagacagccaagagcagatacaatctgccccaggcttccccaggtagtcagtcctccagttaaatcaatggcacaatgattgcaggtaagttggtgatgacattctgagtcacgctgctcagatctaagctgcccatcctctacgtctggtacacagtcctaaggggttcccttcgtctccctcctgtgttaatccctgtgtcctgtaccccactcccctctttactgattccttcccctgcttcggtggtgtgtactctccagtagttccttagaaaggacgcgtaggaggtatgttttgttttatttatttttttctgtgcttgctgtctccagtccagtaactcttgttttaccctttccaagaagaaaaggcagtcaagtggctgcataaagtagaggagattctgtgatataaagggattgctttttttttttgctttccctactgtcaacttaattatctttctcaaatgttctaagtcagttaccacttctccatcagttttccagtctccaaaacataacagctatcgtctcttctcccatgcaccttgtaggtttgctgtggctttcactgggtttcaggagggagtaaaggtagctgtagcatttcacatgttcaatctgctaccctagcatagaactgtgccttcagttttgttttcttggggtagggagaaggaaactagcatatcctacaaaggaaacttttcaaaggcttccggctttccatcacttggttcttccatctctcctgatatgcaaaatccatcctgggagggtgtaatagaggaaggcatatacgtactcctgcttgttcctgccaaagcccagggcttaaactccagatctatgtcacagcatcctgtctcaccttaataaaaacagtctctgagctacaccaaggcagaaagaaaaaagcaacagatggagacccagggtgtctgggttctcgctccaccactgtgtgaccttcaccaggcccccatttccctacctctgacattcctggagtctgtaactccctggaaactgtgtcagtccttcccaggagccagccaagccccaccatccatctgagctgaagaacagctaaacatagggggaaaaggagttaggtgaagtgattctaccccagagaaaagccctattcattagacacagccagcctttagggctcctgagtggcacgtgagatatttgcttcctacagcacgttgcctccagtggaggaaggaagatgatctcagacccaacacatagcaggctccctgttgtgctgacgcagcaagagctgcatgagagagcctgactcgtggaccactaccagggagccagagtgcggccgctgtgcatcccccagcttctcctggcccgtggggctctgcccgctctgtctctccaggcaaggccaagagaggccagacttgcttaccaaggcaaatgattcaccacctagactccccgactcgacctcagcagagctgcggtgctgcctagagatggaagggagacgccagcagcaacggtggccccagcagcttccgcattgtcagcagagctgcaccgggttccactggcacaaccagcaaagctatgcttcccaacaaggactcaggcacagcagccaagagtccctgccacagtaactacagaaaggtggagagaattggctccttggggacttaggagtcactcccttttggtataaaagaggaaaccaaagcaaatgaatgggtacaaaacacccctcatagagagagagagagagcattcaatacagtgaccttttcctgagctagagtaaagctgaactacagtggtctccctttctatgcctataacctgaagaggaataataagcgctcaataaacattcatctggaattaacaaatgaatgcaaatcatcccaaaaggtgtctgcttaaatcagtttaggtactggtccccagctacctgttccagggctggccatattggagtcccctgagaagctacagtaatgatttccaacctttcaaaatatgtcctttcagctgaaaaaaaaagccattatgatgctatttgtacttttagtgtgtgttgattaagaagaaaataataaccacaactaatgtttatggagtccttccaacataccaggtgctaagctaagtgatttacacctataatcttatttaatcctctcatcaatacggaaagtaggtactataactatgcccactttcagatatggagactgaaattcaggcaggctggtctacaagtgggaagagacgaagccaggacatttcattcagcccaggcctgaatgaaatcagtcaggaccccagaccaccatgccatattaaacactaagaaaatactaaacaccctaagaaaatgcttctaagtgaattcatattttctcaacaaaacagcacccatgcacatttgaaaaacagaaatatttacactttatacaaacactgtcaaagatacctttcagtaaccctctccccaagggaaccactgatctcaatgctgcaactataagcacgttatgcagaaagcagtaggtcattgcccccaaggaaggaattacctgtctgcttccatcgcacatccaagcaagtgtctcaaggcctccaactctgaaggggtgaatgggagagaaatctccaagtaagggttaaagcagaaggacagagtcagcagcagaaagagaaaacaaattgaaaacacagcagaaagggattgctacattagcaatcctggcagcatatcagggaaggactaacaagggattaatgataggaaaagagcctgaaatctgtgacccagactgctagtcgcccttcagtggttattctcccctcctcccatagtaatggaacccacaattgcaagatgggcaccaggccactcagaacatttactacattttccagcctccttgttctgagatgtagccaggtaactaaaaagtgtcattgtaggtgctttctgtaacctgtcttaaaagattccagctctaggcctttggactttgttcttcatccctttatacactgtgctatctggaaagtgaatgtgatagctggaggtctagctaccatcttggaccatgaggacatgatcatgccccaagagttggcagagctgtgaacgagaaggaggtaaggctcatggaacagagatgtcttgccaatcactggccatctcatgccaaacttttacatacaagagagacacttatttcagctagtgttactttaagtgtctatttctcacagctaatctaactgaattaatacagagttcaattcctacaaaatatcttgctcattactacagcaaaacagacacagacatatcaaaattgcaaatctaaaccaaaaccaagatcccagtcaacagagtctcagtatgatacaatgaaagatttggatagcctctccaagctgccgtaaagttaatcaacctgaaatctatgttctatactaagtattgatttaaacctttcaaaaataatataataacccacatgtactgaaagcctgtatgtatcaggcactgtgctaaataggcaaggggtgttcaaataccgtgtaaattaaaccaatatctcccctcaagatcaccagccaggaggaagagtcagtgagtgagaaaggataaagcaggagacctttgttatttattacaaggcttgtaatatatttcggctttttaaactagattatgtacacatgacacttcaaatattttatatcaggctgggcgcggtggctcacgcctgtaatctcagcactttgggaggtcgaggcgggtggatcacctgaggtgagttcgagaccagcctggccaacatggtgaaaccccatccctactaaaaatacaaaaattagccaggcgtggtggtgggcgcctgtaatcccagctactcgggaagctgaggcaggagaatcgcttgaacctgagaggcagaggttgcctctgcagtgagccaagatcacgccactgtactctagcctgcgtgacagagagagactccatctcaaaaacaaacaacaacaacaaaatgtatgtcaaaaaggccaggcacggtggctcacgcctgtaatcccagcactgtgggaggccgaggcaggtggatcatgaggtcaagagatcaagaccatcctggctaacatggtgaaaccccatctctactaaaaatataaaaattagctgggcatggtggcacgcatctgtagtcccagctacttgggaagctggggaagagaatcacttgaatctgggagggagaggttgcagtaagccaagatcgtgccactgcactccagcctggagacagagtgagactctgtccccaaaaaaaaaaaaaaaaaaaaaaaaaaaaaaaagatataataggcagcttaatacatgtaactatattataataaaacattagtatataagatgataagcgaaacgtttttcttcactttcatcattgtcgaaatccaaaatcatctaggataaacatgtgtttttgttactttcataaattatttaataataatagcagctactatttttttgcatacctactatgtcccaggtgcaatactagacacttcacatccacattacctcatgcagttttcatggctatcctgcaagttgggtagcatcctcattttatagttgaggaagctgggactcaaagggcaagtaacttttccacatctaggaagcgaaagagtcaagatttgaatcttgctctggcttctaggcctatgctcctttcactataccctgctgccccctccatttgggggtcaaatgttgagaagatacatctctacaataccagtctctcataggccacagtgtatgacccacaacttacttttatttgcctggggacagtctcatattataaatccactgggcataaccttgctgaatcctacatccggaatggaccaatgcccataacactactgaacacagagcccagcactagaagtgggtctctacatggcactatcaagctaatggctacttctcactggcagggacaaggagagaaacctgtgtttagaacagaagagaactggaagagaagccaccaaagctatcagtcaaacctaattctacctctaagtccactgccctttccactagaacccaggaggtcctggactaaaaccaaaccacctgagtcttatttcatatccttctagggaagggaactaggcttttatatttaaatgagagtgcttaagaagttaagactaaatatttggggccgggtgtggtggctcaagcctgtaatccgagcactttgggaggccgaggcgggtggatcacctgaggtcaggagttggagaccagcctgaccaaaatggtgaaaccctatctctactaaaaatacaaaaattagctgagcatgatggcgggcgcctgtaatcccagcttctcgggaggctgaggcaggagaatcgcttgaacccgggaggtggaggttgcagtgagccaagatcgcgccattacactccagcctgggcgacagagcgagactccgtctcaaaataaataaataaataaaataaatatttgggaagctcacagacactcaggatcaaactctaatagcttggcaaggtgtggtggcaaaagcttaccggcaggcagcatctccccaggcataatttaggacaaatatgtgctaaaagcaccatggctgagacagtagcttgtggcttgcggggagggtgttgatgggcaggagaagaaaccctcctacactaggtctgaaaccatttcagaagttttgagttttgctttgagtagtacaggctggaccctgcaaattcaataccatgcctcatcctctacatggtatatccagataaactatgaggaaggtcagtgggagagctaggaaccaaaaacttaaatgttcacaagtgtgagaaaaaaactaataaagcaaaggaatccctacgatcttaaagctctgctctctccgttagagattcaccctcaaaataggtatatatttggcgctagcagtagcaggtaggtcccatatagctgttcactcgggccccaaataaagcattctcaacctagaacctccactttgatttaaaaaaaaatcctctcccatcagcccttaagacactaggctataaaaactatgaaacaccctgaactaaaagatctctcacttttttttttttttttgagagaagtctcgctcttgtcccccaggtttgagtgcaatggcttgatgtcagctcattgcaacctctgcctcccaggttcaaattattctcctgcccctgcctcccaagtagctgggattaaggcgcctgccaccacacccggctaatttttctattttcagcagagacagggtttcaccttgttggccaggctggtctcgaactccttacctcaggtgatctgcctacctcggcctcccaaagtgctgggattacaggcgtgagccaccacacccggccaaagatctctcactttctacccatctctagggcgctgttgcttcgaccaatgcccacctcaaaggggtagtcatttctcaggggaatctccagttcctgcccccatccatatcaaatcaccatccacttatcttttttcttttctaaaatgtgtgccctatccaatgactcatccccagagcagcagaaagcactcttagacagtggtgagaaaggctgaggctcatatatcagaaaggcaaagaataagtgtccactccaaaacctctggaccccagctccactgttcaccagcaaccatagtcagccaagggagaagcattactcactgctcattcatcccaggaaagaccctcctgacatactcaaaagcagagggaatggttattttacagaaggagggtctccttgctccatcacatcccagggttcagaaagtcttccctatcaaaccagtctgatgctattaaaagtagtcaggggatactggctggagtcccaaagcataaggaccactggtcaccagagagtcacaagccctggcaagtcaactcttaagacactagatccttggctgtgaaaagatatatcaggaccatgaggccccaccctgactaatgcagtgtccacctagttctctgcgaagagacaccagcaccatgggtggaaagggctaaagcctctaagacataaccaacatccaagaccagaattataatcaggacagaatccaagatttcactccaaaaaatcaagattcctcccagccaacacgcatgcctgagaatctacctactttggcagaaactggtaaaagataccaaccactgtggttactagaaaaggtcgacagtcacctacacagaaaaaaggaaaggaaaagagagggataaatagatgatcctataaaggaaactaggacggaacctctctctctcccttttgttttttgttgtttgttgttgttgttattgttgttgttgttgttttgagacaaggtatcactctgtcacccaggctggagtgcagtggtataatctcagctcactgcaacctctgccccctgctgccttgggctcaagcaatcctcccacctcagcctcccaagtagcctcaaccacaggcacacatcaccacgcccagctattttttttttttttttttgagacggagtccccctttgtcacccaggttggagtgtcacgacgcgatctctgctcactgcaactccgtctctcaggttcaagcaattctcatgcctcagcctcctgagtagctgggattacaggtatgtgccaccacacctggctaatttttgtgtttttagcagagacggggtttcgccatgttggccaggctggtctcaaactcctgacctcaggtgatccaccgtcctcggcctcccaaagtgcaggggttacaggcatgagccactgcaccaggccaaacttctctcattctggccatataagtctacacctataacactgtcatcatcattgctagcatttactgagcacttaccacatggcaggcaccatgctaagcattttacgtgcagtacttatataaaaacagatgtactgttttaatctctatttacggatatgtactgttttaatctctacttacagatgaagaagctgtggctgagaagtgaggatattcccctgagctacccagccagaaagtggtaaagtggggaccactggctactctcatgctcttgatgatgccttaccctaccccgtccacccatcttgtttgaacacctaacatggaggatgcctgaaactagaatgtacagaggaaggggctccttagaaggggctcacagaataaacaactgctctctgtgctgtaacgagaggacagggtttggtccagggggagaatcagaagaaagaccactcccagcagagggaataacgtgagtccaggtccaagagggctgaggggccttgacatatctaagaaatagtcccttgtagctggagcagaactttcatgaggtagaaagggagaagaaggagccgcagtgaagggctggggcaggactggaagactacagaccctgccaaggaacttggaaatgaccctggagtcacaagtagtttttaagcagaaaagtgttgtgacaagatttgagtttcagcaaaacaactatggttgcagtgagacaaattaaactgaaaaagcaacagactggcagtgagccacagtaagtaacctattacaattgtccaggggacaatggtgaatgacaaactcaagtactggggatggaaaggatgggacagtcagacagagtaattaatttcacatacacggagaaagagtggtccatgagtcctaggaaatctctctgacatcacatcacttacttgctctggctaagtccctgtatgtcaccaatctcacaggaatatactagcatttagtgagttcagcggggtttagtggtcccactcctcctacctctaggctaacattcacccacccactcttcccttccaacaggaactgaagcttctgcagccacaaacacctagaaacagggttccttcattttcagttgtagctaccaactcacatattactgactgctactaactagaccagatgcaattccacagttctggcatgctgagaacagccactccttgccaacgcggctcagtcctgcattcatttgggacatctctggcaagcccccaggtatcagtgcaatgcactttgcaatgtcagccaagggcatgcagcaaggaactcagggaatggcacaacctaagaatgacgtcagaggagacagaacggatagatgagcttcctggggctggctagtgtcttgatccttcagacaggcacccaggccttatgcaaagttttcagacaggctggttagttaacaagattgggatactagggtgatagtttgaaccaggccactcccaaacaactctggctggccataatgtgcatatgtgttctggggaacaagggaacaaatcagatgtattcatgtggaccagcactggagaaacaacccaaagcaccaggcttcctcataatgtgcccacatccatgcctgccgcatgacttaacagcatgaggtgtggatttctgctgccttgttgggctggaggatagaaggagacatgatagggaactaatatatttataggcctcctgtaggcacagcacaattcatcagccttgaaaaatgactcctttaaccagccccaactttctatgggaacttcactttcatctctttcttggaggccgtacccacttcccacatctcccatgctgctgagtgaaaggttctcatgattaaaacagaagaataagcaccatctccctgaccaaacctcccacgtgtctgcaggacacctagctctctctaacatcctaaaatataactgcttcaaaaggcgtcaacttggacacctacagcccttgccatcttgtgcaaattaagcccagaaaacacagctgggactccatccctcacctcatccaggcgcagatatcaccagcaggaaacagaaagccagaggcttttgtgcagccactttccttactaaagaacatctccttaaacacctgcctcccctgaattttctcatcgtatcagctcaaactgactgagaagagctgccagatctccgtcatacctctgaagtacccagctacataccagataaaaataaccaaaaaagaggaagcctatcagatgctcgatggttttgtcaacagaaagcagttctttcttggcaggtggccatggggtgcagccgccgcacaggctctccagggccttgtatccccaagctctgctagcagagttcccttagcaggcatggaaggttgcattttcaaagtggtccatcatctcccatcctctgtgcttttccccagtgtgatcttgacacttttcccactgagaggtgggtctgtgtcctctccacttgaagctgagtggtcttgagactcactttaacagaatgcagaagaaatgacaatgcccgacttctaagctagatcagaaaagatgctacagcttccccatgttcactggaacacttgggtctgcagccttgagccactatgtaaggccaagagccctaagagagccatgctcatggacagactgcacatgggcactcccatcagcagtcctggcctccagcttctcccagctcaggcactgagccatgtgtgtgaacaaccttcagatggttcctgcctccatctgcagcctcccctagccttcaagtcttcccaggtgaggccccagacattgacaagccatccctaatgagctctttccaaattcctgacccaagtctccatgagcttaataaaatgttcttgtttggggtcgtttgttctgaagaaatagtaatggaaacagtaggtgatacactgtgagtctagtctcatatctgctgctgctcttgaattttttaaaaaggaaaaactaccttttactgagcatttactttgtgccaggcattatgctaagggtttacacacataacttcatttaatcctcattataatgccatgagtaaatactagaattatccccattttacagaggaggaaatgggctcagggtcgaggactttgcccaaagccaggtctgcctgattcagagcccacaactgtaccagcccacaactgtaccagcccaggttctctggccacttagaaagaggagctgtttcacatggaagactcaacttcttgggagcatggctttcctagtcaacattccaggtctgggaattgcctaaagaacccaggtgatgggacatggcatcagtgaacacttggctctgtctgagctggggcaggccgccttccctgggaggtcatagctatggcctacctgccctattaccaactcttgaatcctaccccttctttgaggcctaattgttccatcaaggcctcccagggaattctgccttctccagaccccatctcatgtatcttgacacgctgccccctactacatcacactgttctggttgtttaggatgtgtttacatagcacaactcctaaggatggaaagaatgcagtggaagtgacctctatgttatgtatataataaattgaccgtatttcttacagcatgtatgcaatagcaggcacgtcaatttcttatgaggacatttgggtaataaaattacccacatcggttgagaatcatgatctatacaaaaagaaaacattccaggctctgtgacctgcacttcaccccaggcattgcagaggagaaaggatttgagggcagaggaggaagcggtacaagccaccacagataccaccttcatcccatcaccttgcaggcaaggaagtcccaaccacaaaggctcgaaacactgggagttgccattgtgaaccacaagtccttaatagccctggaaagctatgaaacaccaattaaagtttcctatgaatcacttttcaacctctccatgtaagagcagggaggaaccaacctcaagtacctcctcaggccaagactagctttgctctgactcactgtctttcagtctatgatatggatgcttttctaattccttcctcccacctccatgtccattgcatggggaagatgagacttcctagcatcttcctagtctacctctgaatattactctacaaatcctgttccccatgagacagagttgaggatctcaccatggtagggaaaattcaaaactatacaaattctctagatgttacacctcagtttccaggtgaaagccagtcctttccttccttccctgctacctggaaggtgggcataacaggcatacccagaaactgctgggaaaacgctcaaatgccgtgttctctgccttcagtgaatgcccatgtaaggaaaagtcttagaatatcttatttttcctcagtggggtcacttttactcttcctggaaggtcattatcccagtctctccaccaatatactacacatcaaatcaagcatcaaaatgcttgtaagaaacctaaaattggccagattcatggtccatgcaactagagtcaagcatataaagccacagactcacatgttagaagcccaggacagtactgtgtccaaacaacggtaaggtgggaaggaagacggcatcctaaagtaaattcaaattagtctgactcttatttttcttgagcatccaaaggtttcatatgatccacagcaacgcttcctcaaatacccctttttaattccatccactgtccttatagaaagaagctccctcatttcctgctcaaaattcctcccaaaagagctcctgaaggattcactctttgtcccctcccctttcctcccatcacaaagctctaaagttccaggagcagcaaaatccaaattctctttgtgaggtgggcgaaggaaatagccgggaggcttcactcattgatagtccaggtgttattccaccagcaatcaatccaaattggagcttcaaggaatgaacagtgaagtcaaatttgtctttcatagtattcatctaaaagtgttaagtgggcaccacaaagcatgctcagcgctcctccaggaggaatggaactgctctcttgctcacgcatggtccatttggccataaattcagctgcaaagaaacaccccagaaaggcccgctcacctcccagactacacagagctgaaagacgtggcatctgaataaccacacagggctctgcaattaacagacgtgtccaaaccctttttgaatgtttatattacttttctggttaaaattttttaaattccataaacaatcatctgtgaatgtatctgaaatctatatatacttcttttgtttaaacaaaaacaaaccacggccaggcgcagtggctcacgcctgtaatcccagcactttgggaggccgaggcaggcagatagcctgaagtcaggagttcgagaccagcttgaccaacatggtgaaattgcacctctactaaaaatacaaaactagctgggcatggtggtgcatgcctgtaatcccagctacttgagaggctgaggcaggagaatcgcttgaacccgggaggtggaggctgcagcaagctgagatcgcgccactgcactccagcctgggaaacaagagcaaaactccgtctcaaaacaaaaaaaaatactaaaataaataaaataaaataaaaaacaaaaccacaacacaaacacaagtaagtacaagagcccaataacatggaagcttctgcgatggcccaacttctggacagctgtatgcaagcacaattttggttcaggacaaacactaacaagaagcaaagctgaagccgggcacagtggctcatgcctgtaatcccacaactttgggaggccgaggtgggcagatcacttgaggacaggagttcaagaccagcctggccaatatgttgaaaccccatctctactgaaaatacaaaaattagccaggtgtggtggcaggcgtcagtaatcccagctactcaggaggctgatgcaggagaactgctcgaacccgggaagtggaggccactgtactccagcctgggagacagagtgagtgagatggaagaagaagcaaacctgaggctacagaaggatggctgaggttcaaattgtgcttttggaggggccctggggaaaagagaaatgagaaactagctctcaggtcttgtgcattttaggaccatcaggtctggaggtaccagaggtcctgggttggagaaataaaggatcccctatctgtagttcgaaatgtggggatgatctaccccacaaagtccccaagaccaggtttaatgtccaggtctagccctgttgcacccagactctggtgagtcacagggtccgtcctgcagaacaaggtgctagagaaggatctcctattgcagtctgtttccaacaagcagagcagaaagaaaaccatgcaagcactcaagagcctggtatttgagtccaggccctatcattctctagctatgtgttcttgggcagggcattgttaaacctccctgagcctcagcttcctctgttataaaatggggatactaccacctcttcctggagtacctcaggtagatactgtttcaaataaaattctaaaggaccaaatacaaagcatgattacaggagtccctccttatcttcaggggacacattccaggatccccagtggatgccccaatccatggatagaaccctgtatatactgttttttcctatacattcatacctatgataaagtttaatttataaattaggcacagtaagagattaacactaacaataaaatagaacaactatactataagaaaagttttattaatgtggtttctctctctctctgaaaagatcttgttgtactgtattcgcccttcttgtgacgttatgagatgaaaaaatgggtacgtgatgagatgaagtgcgcggtagatgacataggcgaggtgacacagtgacacagtgtttggtactcccaaccttctgatgtgtagtcagaggatcgtctgctttggatgacccgggatcattgagttgtgacaatgtcaatggttggatgtcaggacagaccatgtggatgactaatgggcaggtagtacacccagtgtggacatgctggacaggatgtgattcacatcccacacaagaaggggtgggaaggcgtgagacttcattgcgctactcagaatggtgtgcaatttaaaacttatgaatcgttatttctagaatgttccatgtaatatttctggaccacagttgactatgagtaactaaaaacagggagagtgaaatggcagataagaggggactaccatactctttctactacctctaggactatttgggggatgaaggaaatgagggccatgtattactgtcaccatgaataataagccaaggagagtatcagataatatcaggttacactaataatcttaagtcatctgaagcttatgtgggaaaattttacgtccttagttgattttccattgccatccatgggatgtgatgtggcatctccccttgtcactagctgctgtgcatttgggcaaagcaagctattttattattaatttaatccaaatacttagtaagggtaggtctcctaaggcaggggagaggggaaaacaactctctatcacacaactgtgccaataacagggagattattaacaatccactccaggattcccatctatctctcagcggggattcctatctctaagcacagggagccaggagtctactgcttaagaaataaaaaatgtttttattattcttttcttcctaaaaattgtaccacctagaagaatactgaacactgttatccttctacataacataccaaagaccgagttcatgttagtaaccaggaaaaacactgacttcaccccaaactttgaccttgggaccttacaaggaaattgtccccctggttcctcgaatggggtacagatcctgtttccactgttgtctgaaatactttggtcctagctggaaagcctggcagagtaacagtgttccattgtcgggctaaaagaaggaacactatcatgagcatcaggatgaccttaggcaagtcactcagcttctctagttcacaactgtaaggttccagtaagctctaatcatatctataagcaaaaaagaaagtcaagaatgaccagaatccaaaatctatcgctattttccctacccacagtccttttctccttcctcttatttattgtttttatttttagttttttggtttttcttggtactcactgattaaggcatcctccttcctcttggaccctgaaggttaacagaatgcagaaacaaaaacaaattttaagtgtccagatggcatgtacaccgtgaataaaacagcaggaggagatgaggtatatagataagaataggaaagccaaatataaagatgaaaacagttgtatctgcacactggaatctagcataactatttttttttcctttttcaatgatactttttcctgttatattgcctcataagccacatcagcttgcagtcacaaggatttgcagagaaagatcttaactataagatcagtcactggctgggcgcagtggctcacacctgtaatcctagcactttgggaggccaagacgggcggatcacaaggtcaggagtttgagaccagcctggccaacatagtgaaaccccgtctctactaaaaatacaaaaaactagctgggtgtggtggcgggcacctgtaatcctagctactcgggaggctgaggcaggagaatcacttgaacctcagaggcagaggttgcagcaagccgagatggcaccactgcacaccagctcgggcaacagtacaagactctgtctcaaaaaaaaaaaaaaaaagatcggtcattgccagcatcctgatgcccacctgctgcaatgggccccactcccaaacctgctccaagggatggatggacagtcagtaccttcacagctgggcaattccaaagacacacattgggcttctgactttacaagctactccaaggaacaccttcctctagggtcccaagcccctgagaagtttatgaaatagatatataaaagcaaaggcttgaagagaacaaacaaagctcattcagtaaaagtgttttgagtccatccagaaaggaactagggacaaaaaaaaacacacaaacaaaacaagattttttggttggccacattggaattgccaccaaacacctgggctgctacatgcgaagtcctatactagggatgatgtgaggggagacagagatggggggagcaagggaagacgaagggatgaaaaacagcaacacctctgctgtccagaattctattgggatttctatgttttcatagaaaaaaagttatcagagacaaaaagatacttaatcgcatttgcctctaagaagtaaacttagggtttgggagggaaggacagagacttttcttttttctctctctttttctggagacagacttttctttgtatttcaattttgtcctatttttacccatgtgtatccactacattttgaattttttaaattctacagtacaactggaaagaatatgactaaaacaatgaaaatgcaagtacaagacaaaagataccacccaaaaatataatcaccaattgtgatctaaatactaagggaataagtgtagcagatggaattataattaaaatggtcaatatactgggtgcttattacgtgccaggcactcctaagaacttcacctagatgatcttatttaatcctcacttctaccccgtaagatgagatcggtggtattatcattattcccgctttacatctgcaaaagctaagccacagagggtgtatcatttgctcaaggtccttagctagcaagtaacagagccaggtaagactcaaatccagtttcacccacagttcacatgggctcatccccaaaagaagagagggttcacatcctaaatgagggctctaaaggagaagaggtgtggtgttgtttggagaatgtctatgcgggaaggaggtatgtatgggaaagacacagtgctagaatctgtgattatcaaaactataaacatttcttaaggacctactaagtgctggacacaaccagatttagagagtagctgtaggaaacaaagctcttatacagagatgaaaaagggccagacatgctccgtttaccttccaaaacaagaccacaaaactcaaaataaaatctcttcaatccaccctgaatactccagagtcttaaatgacactgtgtaacaagaaagctaagttgacatagggaggccaggagaagatgtgaaaaaagcagactaatgcagcagagaagggagggaaataaatatattgccttcctcctggggcaaaagcattttaattatcaactgagagtccagcagagccataaaactggccagctgtcccattcaatcaagccaaaggctgtaacagacaggacgaggctgcatttttcagaggaccaagcacttcgagttaaggctgagtccagagggttcaagacgcacgggccgtttccacaagaggcttttgcacagttagaaggggctggtggggctcaatccctttcaggggcttcagcagaattaaatctgcctgtttcggtgggaatagtaaaactatgcctggctggcttaggagagggctactcagggctgcctaaaatcctcttgcaccactttaaaaagggaaattcagccatatcctgtgtgcaactaaaataacaaggaatggaaagaagtttctcctactccttagaaaggaaaaaaagcacagtgccatttactgaatgcagtgcctgtgtgatactgacacataatagctcatatcatcttaaaacagtactgctcatttctgtgttgttcatattttacggatgagatttcctgtgactccaagaggttggccacgtgcccaatgtcaagtgctcaagaagtagcttaaatccaagtctatctaactcccaaggcggtgtttcttccattagaccacggtggttcccaaaaccaatcttaaggggaaaatgttttcttctcagatcaaaaccttcaagtttcctatagagagcaaaaactttagggaagttaggagggaaagggacatgcaacccacagcttttaatatgtctaatgtatatgtctcactcttacagtatagtggatcacacaggggacatgttcttcctgttattctgcaggtcagtggggatatatgaggcacacaattaaagtcgcctaagtgaccttgagccccacctggaaaagccctatgttgtttcaaaaaagtgagcaggaagcaagtgtaaatcaaagcagcagcaaagctccgagacaccaggatgccccttgcttagctccaaggacagagtagcaggcgactaactgtgtcctgcttctaggaggaaggctgtccttggattattgtgaatctccaggatggttcatgtgaccagagcatcttctctcagcaaggccatctgtcatgccctgagcagcagtgggggaaggggaccacttgtgggctcctgtcaactgttttctccactaaaccactcagcaaagattccctttcagtagattcagcccaagccagaacaagccccgaagtggggaacctgagcacatagcagcctgacatgcacaggcagacaaaccgtgtagtcactaacattcccaaatacacagacattcatgctttaagtcctgggcaggacctcagagaccacctgtccaaacccctcattttgcagatgaagaatctgaggtccagagagatcacagacgtgcccaaggccacccggccagtcagtgtcaaggacagccctggggcccacgttctttccactgcaccagaacacctcttacacagatgcccaatttaagttatctgtaatgatattgattcataaccttctctgagtcttacaataataagagccctgaccttttccctccaaaatgaatgtatccacattttgcatggaaccattttgcgtggttccctggccctatgttaatctttacattataagaggaacaaagtgtggttctacaagaggctgtcaggggtattgaaggggactccacagtaaagacctgggctccctggacctgggatagaagctacatttttctcctgactcaaccagaccactgacatcactgctttgtgtgccatccataagtgaccctgagctacatcatcgaaacaaggtgaagaaccaggttaaggaatggaaatttttccaagagatgaggaggaaaggagaaataggcaggctcttctctcatctcctcagagatcctgaaggacaaatcttgaacctgaacaatgacggtgccacagaccacccgcaaactgtggtcaatacctagctcttaccaggtttggttgggagggatgtggggaagggaagatacaataaaatgtattacttactttcaaggcaatagtggctcaaatcagaggaaacagatcaaagaggaagagactaaatactcatctggaaatcagaccccacacgcctttcaaagcctttcttgccctgaactcaacccctcaccaaggctgttttctgcaactaaaagctcatggtccagaaaccccaaccaaggcccttcatacagcacaagcttctgctccaactccagcacagcattatgagagcttaaaagttgcctggtgtcctgagctacttgctgccccactgagtaagctgcagagaacctccacggtgatgaaataggaagaagaggcaggcagaactctagagcaaccgctgggaaatgaaggcacgtggcccacaaagagatccattccccttacgaatccttctccaccaaccacaggaaaggatggaggcaagagaatccaagcacgcaatttgcctcccaggaggccacactgtacggggcactgggcctgctggcctcactgcctggaacctccttgccccaccttccctttccactttgtctccactcttgcctctctcagatcacgtcggaaacaaaacttcctcagagaattctccagcactcctctcgaggcatgtcccgttatcagccatgctcatggtactcaccacagtcttgactttacattttgtgccactttattttgatcaaggtctttccccctgaccccacagggagctcctggagaggagggcctgtgtcttttttgtttcctgctgtattcttaacaccaggacttagactggcccataaaagaaaaccaactttgtgcaggagatggccacaaaggcacaggacaaaagggaaaggcaaggttcccaaaccacgttcaagaactgaaagatgcaacaggacttgcaagtcagatctccggcctcaatggtttcttctgctgagtcctgttcacccggctggttatttgcttcatttcagctttattcacttacgtatttattttggcttgcagaacatatctctgtattcataggaaacgctacccatcaactgaacaggatgctctgagacacgccaggtggctgctagctaacctctggcatagcctcctgcaaccaaaagataaatccaattctctgagcgcttgtacacttttgcctgggaaaatcctcaaaacacatccatcatcctccaactctctgttaagaaggaacatgtggcaaaaaccaccaaaggacctgactaaggaaaaaaacagggagtgaaattcagaagtacctgagccaggtaatgccagaagtatttcatttggagaggcctccatgaagcatacaaaaagtcatttacttacctctcaaaaaggaccaagacttgggttttccagatgatacttcactgccttccaggtccactctgggaatgttttcctgcctatttcattctcttgtaggaaaaaactgcttttacagctactcctcatcctttttcgaggcaagtctaatgccacatcatccctgaccagggtgcctgagccttagctgcttcctccatcaggcagaatgggctctaccatgcgtgcaggacgacactagagactgggatccagtgggtcccagggtgccacaggtctggcagccagcaaactcaccagccatgagaaatcccacacaggaaaaccagtcaggagctttggctagtgtgtggtccaggtatactccagggcttagaatgttagagcctgctgagctgaggccaatgggaagacaaaatctctatcatcctcacactggtgaaagcatgtcttcagcttcctgaccttgtgaactccaagagaaggttggagacgaggacaaggtgcaagtgaacagaatttggagagggagatgctacatggacctccagttccaacaggagcagccaatccaacaattcaacaaaactggaacaggcaccatgaggagcgtgacaggcagtccccaagttgggaacaaagggagtactgaggttggacagaacagactgggagtagacccgacagcaccgggcagtggtcggctccagcagctcctagcagccggcaactggctacagtggagacgtgggccagtgagttagccagggctggtgatcaggaaaagtgtgaagaggggaggaggcagaggcgtttgggattaataacgaatgtactgtcacaacaccacactccagcatccaaaacaggtggttgggctcagacaattaagatggatcaagggccaggggactctaacgaggatgaaaagcaaattccatatggccgggcctggtggctcacgcctgtaattccaacagtttgggagaccaaagcaggtggattgcttgagcccaggagttcaagaccagcctgggcaacacggcgagaccctgtctctactaaataaaaaataaaataaataaataaataaataattccacacaagtgaggtctgaatgacacccatgggtaagagaaagggaacatttacattttgggatcacgtaagtaaaccagttcacatgatatttcattcattcattcattcattcattcattccttttatctatacatttattgaggaccctactatgcacctggaactatgctgggagctaaagacacaaaacctatttggagatgtaagggatgctcctgaaatcatagccaaaaaaagaggccaggttgtgtaacttggcaggttggcttacaggccagcacggtgttttgtttcgttatggcctatgaatgcctaccagtgctttaaactgactcaccctggctggatggcagttgaacttgcagccattagaccaggggttctagtctcttgtcactccaatattcttctacgaactaccaggtagtacacattcatcaaatgatgacttagcactgactacagcaaggatatgtgatgggctaccagaagcagccaggtttgaactgagcacagaaaactgcggaagggttggacaggcagagagatgaggcgagggcacccctgccagcaaggaggaaaggggagaccagcttggctaaagaagaaagtgcctctagaagaagagaaggcagcaaagatctcatgatcatttaagctgacatctgaaaagaggaagacaggtgtgcctagccccaaaccaaatacagttcaccactcacctctgctctttcagctataaagttaagaatgagttggttgaaacccaaagaaggtacaggcaggggataaatcaaacattaatgcaaagtggatgctgtggccttgtgagcagaacgacgttattcccaattatatgaaactaaagcactaggccacacagaacaacaatgaaataccccagctgtccaacaggagtgtgcaggcaagagtgtagtgattagggccacaagctgacaacacactgacagagggaggagaaacacatgctacaagcaatatttttgttaggctattatctaggggtaaaaataaacatgcaaaaatgcacagaaaaactggaaaaacacacagtgtttttacccctgtttttccgttttctttttcttttcttttttcttttttttttccaagatgttgtctcactctgtcacccaggctggagtgcagtgatgcgatctcggctcactgcaacttctgtctcctgggttcaaacaattctcctgcttcagcctcccaagtagcttgaactacaggcacgtaccaccatgcccggctagctttttgtatttttagtagagacggggtttcactgtgttagccaggatggtctcgatctcctgacctcgtgatccacctgtctcggcctcccaatgtgctaggattacaagaatgagccaccgtgaccagcctctttttcttttcctttttttttttttttttttttgagatagagactcactctgttgcccgggctggagtgcagtggctcaatcttggctcaccacaacctccgcctcccgggttcaagtgattctcttgcctcagcttcctgagtagctgggactacaggcgcatgccaccacgttcggctattttttttgtttgttcttagtagagatggggtttcactatgatggccaggctggtctcgaactcctgacctcgtgatctgcccacctcagcctcccaaagtgctgggattacaggcgtgagccaccatgcccagcctctctttttcttttatttatttattttttttgagatagagtctcactctgtcgcccaggatggagtgcaatgttacaatcactgctcactgcagcctcaactttccaggctcaagcgatcctcccacctcagcctcccaagtagttgggtccacaggcatgcaccaccacacccagctagattttattgtattttttgcagagatgggattttgttgtgttgcctaggctggtctcaaactcctaggctcaagagatccgcccacctcagcctcccaaagtgctgggattacaggcttaagccactgtgcccagcccttttctgcattttctaagagaaggaaagagttatttaatatgaatataaaagtaatgagaataccttcactttcaatgtttttactttccaaagctttttcatattacttgaatattgatatctttacttatttaacttttttcattcttttttctttttttttttaacagagtctgtctctgtcacccaggctggagtgcagtggcacaatcttagctcaccgcaatctctgcctcccgggttcaaatgattctgcctcagcctcccgagtagctgggattacaggcgcccaccaccaccccaggctaatttttgtattttagtagagatggggtttcaccatgttggccagactggtcttgaactcccgacctcgggtgatcctcctccctcagcctcccaaagtgctgggattacaggcgtgagccaccacacctggccacttatataacttttaatggccactattaaactgctcttctgcccaatgccgttacaccaagccacctactatacaaaatcctgaagtcatctacctgcccccaaaaggacaacctttccatttaagaccatctttcaacaacgtgtttgctaactatcatgtaactggttttccccaatttgatggagaagagacacataaatccatttttatagccagaggctttttacaagtagttttagggcgtgatgcttaagttaatgatgtgatgtggtaaagtagtataaaccagtagttaagccaggggtctgagccacacgtcccagggcctggctaaacttgtttggctgtatgatgctagacatctgaggtaacagttcataccgatgcatgtcctgcattaagattccatggtaagactgctagctgccaattccttagcggcaatgcccttccttgataacagatcctgattctcagctgggttcaatgacacccagcataaaagcctccatctccctgtctcctctccagcgagtgatggccaggcgaccacactctgtccaattaacacaagcacatacgccatgctggacttccgggagattaatgggagccaactcagccacatggggcaccttttctgtgcttctgcttcccctcatccttcaggcctgtgacttggacctcataactggcagtccagcagccatctggaccacagggtgacaatgaggatggaagccaagtactgggatgagggagtgaaaaataggagcctgggtcccagatgacaatatggagctgccctaaaatcctccgggcttcttttcaaagacaagtcagtgtagaccttgtttagccgctgttatttggtttggcttttcgggctacgtacggtcaatctaaactcaatgcagattctgtatcaacataggatactatatgccatacgcgtttcactgccagtaaactgcaaatgactttttaaagtagatgaccaagataataaaacattttaataagacactttttactgaacctttctaacagctaggggtttatcatcaactgctttctctttcccacaaagacagctcctgtgtatacatactcttttctcgaatggtcaaagtcaactaacacatataattcctagtattctgccctcacatgacaatgaccaaaatccaattctctggaacccttaacaaagcaaggaaaacaaaccagtgttcccaagtctataaaatacaaagaagttatggctcccaagctggaggcaatgggcaaagaagtggcataacacttctaagataattttaagcctgggccacaaagcaagactcccatctctattaaaataataataataataataataaaattttttaaaaaaaggcttggtgcactggctcacgcctgtagtcccagaactttgagagactgaggcaggtggatcacctgaggtcaggagttcgagaccaggctggccaacatggcgaaaccccacctctactaaaaatacaaaaattagccaggtgtggtggcagtctcctgtaatcccagctactcaggaggccgaggcaggagaattacttgaacctgggaggcggcggttgcaaagatcacaccactgcactccagcccgggtgacaaagtgagaccctgtctctaaaaaaaataaataaataaaatacaatcattttcaagtcatgtacacattgcaatggagtaagaatggtggtatcatcgaggctcatattagacgtatacaatccttggcaaacatccacccacagacaaacgtcaaagtgctaccccaccacacatgtaagatttacaactagcatcaacatcagcgccaaccatgcagtccaatggaccataaacattactgggcagcaactgtattgagaatgtcctttaaaatactgccgaatgtttaagtattatacaacttctgcaatcctgatggctccccttggcaatcctaaaacccacataaggaaaaagaaaggaccagagttttgtctcctgaataacagaatgacactcaggtctcttgccctctcctacaaacagcagaaccttaacagggtaacttttcctgcataagagcctccactcctaaatacaaatctcataagaggtaaaaacgtgtatgaagagcttaaaattatactcaaattcaaaacttcatcaagtaaactattaacttttacaactttgttatcctagcccaactttctaaatgggttcaattatgtaactttacagtactttgcctacttctctcaacatgataaaaatattagaaaaagtaaaataaagaaaattcagcttctccatcacattttccagcaatataagcaatctctaggtagaaattactttgaaaagaggtcaccaaaagtttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccaaaagttttaatttatttaaagaatagaatttgagtgggggtggggcggggatgaaaatcatcatgataaagagacaggaaaatggcaaagggaaaaagagaaaccagattttttacgtaacttaaatacttcacatgcatcatatctaaaatacatatctaatgttccatacccttacaagaaggagtttttctattattaagggggaaaagaacacaggtagaaaagataaatgtatatttgtatatgcataaaccagatacgctttaaaaatgtcgggaaggatatgccaaatgtaatagttgttctctctaaagggaaacattataggttaacttcctcttctttttagctgcactttctaattttctacaatagacacttactacttacataattttttttaagagatggggtctcgctatgttgcccaggctggtctcaaactcctgggctcaagcaatcctcttcgccctcaagcctcagcttccccaaagtgctgggattacagacatgagccactgcaccccaccactacttacataattttaaaatgtagtttttttgtttgtttttttgagatggagtctcgctctgtcacccaggctggagtgcagaggcacaatctcggctcactgcaagctccacctcccgggttcacaccattctcctgcctcagcctcccgagtagctgggactacaggctcccgccaccatgtccggctaattttttgtatttttagtggagacggggtttcaccgtgttagccaggatggtctcgatctcctgacctcatgatctgcccgccttggcctcccaaagtgctgggattacaggcgtgagccaccgcgcctggccttaaaatgtagtttttaaagtaaacagattcaccatagtatcaacagaaaaataaaccacatctggaacagcctggagcaaaacaaagtctgaaggatttccaggctcaaagctgaaggatgcaaagagagtgaagtccctgggggcccatgcttcccccacccaaagtccttcaactcaaatgccctcctctctgggacaggatgctccaagtgattttaagtacataccattatgcaattgtgtcctctttaccacccagtttaggcaagagagagcacaaactaccacagaaaagaagcgtattcctagccctgctgagtcagccaacgtgaaggactggagcttctaccaactcaccatttaatatttaacacttgctttaaatccagtttatggattctggatatttaataaagagttacttctcagttccctgctattaaacactaggtaattatggcatttaattaataccacccttgggctaccaggaggttggtgatattaccaggaagtcatgctctccaaatggacatcaccacctgaatcagctcacagtttaaagaatagcattctcttcttacagtcccttctgtgatgggtatctcaagttgaggtgtttaggtaaacattcaaacagataataaaggcttgctctacctcttgttccacaaagaggaaaatcccttttgtgataatattcacacttcccacaagttttgtgcacagcatatcagaattacacattctgatatgtggaaaaatagtagggaaggccactctagactgctaaaaaaaaaagctcaaaattatcccaaactcctcaggcgcctctttcctctcttcctaaaccaatctttcttggcactcatctcacctcctacatctccattcaaggatggaatgtgtttaagcaaggagtttcactgccctctaaggttccattagaagtccactcctactgacgtcgtgggatacaactgcaactgctctgagcccctccagccccatctcttcatactcactgttgctggacttaaggtcgcggtggatgatgggaacaattgcctcatcatgtaagtagttcatccctctggcaatctgcacagcccaattcaccaggatgtctgggggaatccttttcccagataacactctattcaaaggtcctccacgagcaaactccatgaccaagcagaggttgggctccttcagacatacccctcttagggcaatgatgttggggtgcttcagcatggcgaagagcttggcctcttggcgaacattctctatggtctggctgatgtcctcatcagggtcgtggcgagctgctttcacagcaacctcatcccctatccagaaagcacgatagaccttcccaaagcccccgatgccaataatctcttccaaggtgagctccgcaaaatcaatttctaacactgagaaagggaagaaaaaaagaagcaagtcaaaaacatcttgaaaacatcgtatttaacctttcatttacctgagtgggtaaacacggcaagttgtctgtttactgggcctttctgtctccccattataaagcaaattccataagggcaggaactgcaatcaacttattttcctttgcattttccttagtgacagtcaccacatggtaggcattctataaacattcatgaaaaaaaatcccacctggaaaatcatgcagaatcctgtaccaaaaccaactattgtcactaaagggaatatgggagaggtccttttttttcttttctttcttcctttaaaatacatttaaatatagagatggggttttgccatgttgcccaggctggtcttgaatgcctgagctcaagcaatcctccagcctcggcctcccaaagtgctgggattacaggcatgagccactgcacctggccgagatcctttctttgagacttactcagctttactgtgtactcagtggtgagaagcacccaactcagtgccaaggcagacacccaacaaccaaaccataggatgagaagagcttctgcagaagtatgattagaggcttaggaaaatcactagctcccacagcagcacagagcactaagggggtgagtggggaaaggattctcagggaaggcaacatttgaaattggccctaaagagtgagtgggagagatctcaggcgatgaaggaaatcagggcagggaaggacaatcaggcagacggaaggacaggagccaagaacatggagtacgaagtatacggtatattaggacctccagggagtctgctgtggccaggtcatgtgcatcaggattggagacgaggctcaaagccttgttgagggtaaccaggccaggaaatgtctttaaagccattctgaggggcttgaacatcacattgtaaacaagaggagtcatgtatctttcagaaaaggaatgttgttagacctgtaatttagaaaggaaatcaactctggcagccactggaaactaacctggaggacacagacccaacagcaaaaggaccccctaaggaggccttgcagctcagaggtctgaacctcagcagcagtgaatatagggagtacgcagtcaatttgggagactttcagaacttggttctacctggacctggagactgaaacatgggaaaggagcctcataagagatatcttactccagcagtcatctgtgcctcagttcaagccctgatgatcccagtatcccacccagtatcccaaccaatcattctccttcccaaatccagaatttgaacctaaggtacttgattatatattttgttgtgtgtggaaaggctttcatgggtagataataatagctgccagtgattataaagcgagctacatgtggtgctaagtgctatatgagcaaagtgtgttttgtttcttgcatgaaaccctgttctctatcttcttttttcttttgtctttacctggctgattcatactcatacctcaggtcttaaatatcagtttcatagtggaacttctccatcaccaagaccaaatgaggtcaggcccctatcaaacacttccatggcagtttccattccacaagaggcatcaagattataattacttaattacttgttcaatgcctattgtccaggccagattatgagacccacaagggcagagattctgtctgccctattcaccactgcacttgccatgccaaacattttgtaggtaaccaagagatccttgaaataaaatggaaaaaaaatctacttgatatggtttggatatttgaaccctctgattttcatgttgaaatgtaagccccagtgctggcggtggggcctggtgggaggtgtttgggtcatgagggccgatcccccatgaatggcttggcaccctcctcacagtaatgagtgagttcttgctcgaattcacacaagatctggttgtttaaaagagtgtgacacctatctggtttttctctcttgctcctggctcccaccacgtgacatgcctgctcccacttcaccttccgccatgaataaaagctccctgaggcctcaccagagccaagcagatgctggtgccatgcttcccgtacaggctgcagaaccgtgagccagttaaactttttttctttataaattacccagcctcaggtattccttcatagcaatgcaggaatggactaacacactatctcaggaggaaataaaccaaattcagatcttaaaaaaaaaaaaaaaaaaaaaaaaactgaactggaactagaccttctgaaacaaatacagaaaataatcacacttcactgaaaaaaaaaaaactaagaaaacaaagatacatttctgaacttttggcaagaccaaaagaggaactgccactgctgactattcccttccttactcagccagccctgtaacgcctccgttctccactcagatgctggtggtgctaaaaaatctgttcttgcttaattatagcacctctatcccatctgaggttagcccatctgtattttgtaatgcaactggcagtctgcacaaaggaaactcttaggtggatgttagtggatagtctttagatatacaaaaagtatagcccatcctgacctcaaaattccaactgtttaaagaggttatcaccttatccagcaatcttcctgaagaatgaatgtcatggcagaacattgtagactagcaatcggcatccattccataatccttctagcacaaatttcagtactacagaggctaggaagctaaaaactacatttcccagactcctttacagctaaagttctgaatgcagattaaattctgccaattagatgcacaatatttgaaaggcagaagtgagatgaagaccatgttcttgctgcagggattttttgcatcagcatgttggtgtccaatcactaagtctgtagatgtggagaggaatgtttcatagccaagtggttgcctaatctctgggctgcagacacaacagggtgtttttgaagccaacagcttcaatggcagctcctgattctgtatgttcccaattagagaagtagcagctgacctggtgggccagttctgctatgttctgggagttgttcacataggtccagctgagagcctcttctctcagcccttccaacaattctgcaagcacagaatttcctgtgctaaatctctttcttgctcaaaatagcttgagagtttctgagccccagaatgaatccagacttattactaacttgtgcctgatgtcatctatatgaatgagaaaaatatgcctatgttataaagaaagattagaaactctcttggagaaatacatgttaagagtcttcctggtcatggagggaggaacattcatgtttttctagcagcttttacacatatgaaaagatgtgtgattacttaacaaatttgtatctgttttcttatttcctcaactgagtatctgaattctccttaagggaattttaactattgtactttctcttgtaccctcccttctttcctccagtcttaagcatagttgtaaacacacagtaggtgttaaatattcatttaaatgcaggagggattgaaaaaataaatgcagggaggtttaaaagacatgattcagtactagggtgctgaaaggacagctcctctaaaaacctctgcagggaagggaaagcaataacctctctttgagtagaacataaaaatctcaggttcttgctatttagttaagcaaatattatgacctgactccaagaaaagtatagaacacaactttcaagcagataaaagacagaacccagaaagaagggagggaggaaggaccttctttttccttccctgctcagtccctgtggataggaacgaaggaactagaccttcagctgcagcagagtatgtggggctctccttcccttccctgctccagtcaagacctggttttaagtaagaatcaggtcaagctgcattcagcacatttttcagtttctgtggaaggatatttccaggaatatcaggaataaatccttagttcttccatttttaaagtcaagatgttattccctctcaatcgtatgcttggaaactgaatgtttaggcatattttggtgggttttgagtaagtgaatgttatatacttcactcaaaaatcttaggtacatctgaaaatatgtccttctatttctagtggatgtagataataaaaaacataaactaataaccttaatgtatgccctgtttgaaaactgaaacaactctcttgttagagaaactttcatataatacctaggattgcatctcccaagataatgagtttggaactgtacatttttcatctttcactaaaataaagacgatggatgagctcctgggttatttatacttgtcatccatagacagctaaactctaacaagtacctacaatggagaggattaaagcattatatgaatgtaaaatgatttataatatcatttttatatgttttctttgtcataatatttagtaatttccccttctgttttgaataaagtttgaggccagatacagtggcttatgcctataatcccaacactctggaaggctgaggtgggaggaatgattgaagccaagagtttgaaaccagcctgggcaacaaagcaagacctcacctctgttaaaaaagtaaataaaaataattggctgggcatggtggcatgcgcctctggtcccagcttctttgggaggctggggtgggaggatctcttgagcccaggagttcaaggttgcaatgagctatgattatgccactgcacttcagcctgggcgacagagtgaaaacctgtctctaaaaattaaaaaaacaaaaaaagcttttaaataaagtttgaagctaaattttcactttaagaagcaataatatgaaactaaagctgaacagtattgcttgacttaatgtcttctattcatggtccagaatgcaacgtcacaacacatgctcagaggagaagttcaaaagggtaactctggcgatgaagtgtcagtggctcaatttcattccaagtcttcggagacaaggtttgtcaatcgtcttcactttccgagtgacacaaactgatctggtagagcacatagacttcaatgaccgcccatgttcaccctctgatgaaccaaggcactgcactgaagttttatatttacatacttaatctccctcatgtaacttataagcaacttctgatcttatcacttctttatgtcctggtacttaacacagtgtacagtatctatcactcactaggtactcaataattagtttttgactgaaactaaattttctgaattatcaaaaattaattctagtcaagatcagaactcctagtgaggccaaataaaagaacgtgtcaggtctttcaaatgccatattcttcaagttaattctttccattagaacaagttacttcctactttctcaacatctgggttccagatttaggaatccactctatccaagataacttgtatgacaatgaagataagtcctggccaccaaatgaaaaagtagcacgctgttgccatgcctagctctgtggacagtttttcagcctaagtcatactgactcttgactgctctagcagccagagcacaagatattgaagaaaccgagttcctgatcacgaacctcacctagctcttctgctttgacattagctgtccctgaaaacaaaatcacaaaacttcacccacagaatcaaaatctgacttatgtttaaaatgacactgttttctaacatgccaggctattcatatttcttccaatatatgaccaagttcattttcaacactttcaaaacactatgccaggatgcttagccttaaggctaccaaactagtcccaaaaagatgtagtatctggaaacaatttaaagtaatttgctacctccaggcattttaaagatcaaaatgaagaaaaatgaagttttaaactgaatgagagggagagggggaacctaaagatttgaacatcgatttgatagtcaaaacaccaacagaaaaagaagagcagaaaaacaagcgaagaggctatgattttgatattatgtgctagtttttaaaaaacatctaaagataggccagacacggtggctcacgcctgtaatccaacactttggaaggccgaggcgtgcggatcacttgaggtcaggagttcgagaccagtttggccaatatggtgaacctcatctctactaaaaatgcaaaaattagccaggcatggtggcgggcgcctgtaatcccagctactcaggaggctgaggcaggagaattgcttgaacccgggaggcagaggttgcagtgagctgagattgcaccactgaactccaacctgggagacaacgagactgtctcaaaaaaacaaaaaaactcaagattaaagtaacacaattgctggggtaaaaaataacttacagagccaaaaacgtaactgttacaaaggaaatcttaatatttaaatatttaaagttggtccttgctaatgacgttttaaaaaatcaactaagatgaaagtatacaaaataaggaataaacagtaattaatacatattaacaatacctttttaacagataagagattatggaaactctcaaatacaaaatagtgtaaactgcactaaagagatatttacatgtttttttctgaaataaactagtatgattaagggattgtgatggcaatttaactcccttgaaaaaaaaagaagatttcattatagggtatgaaatatggggctcctggaaaattgacggaaaccaggacactgggagaaaggccctgggagggacccctgagcatggtccccctgagatttgaccagttccaaagataggcaaggatctagaatgagaagaaagaagaaaatgtatttcccaaacagcctcactgtcaaaggactgggattcagccactgtaccttgcaatcctgatctcccatgggggaacgacatactttttcctctctaatcatcacttgtctcacccccactctcaacacacacatccctcttagcacattaatcagtgagactcctaaaggtacaacttctgagatataagaaataggatccaagaaatcaacccgacattttacaggcaactgagccttgagttcacacatgcttccgggacttgtgagccagctcagccctgcggagacacccccatctctttgaaagcaaatgcctttaggaggcggggacaggcgttagaagaggtggtggcaaggtccctgatttggggactaaggctaggacactaaccaccatcttgccataaacacttccagattgggaatggggggcggcgggggggtgggtaagagaagggactgggaaactggcaaattctcagactgggacttcaggatgtggaaatcgggagccactgctgaggtggccaactgaaggtgaagaagcccaagcgtctgaagtgcgggcagggcctgaggcgtctcgagcttatccagcaagcaaagcccgggcagcctaagcgcgcgccacccacacccaggtcaatcgtcctccccaccccccgccctcatcccagccctcgcgcagtgctccccccttccccgaccgccccccaggcctccgtcattccccctccccgcccggccccgccttcgccttacactgaatgggcgggtagcaactggggtcctcgccgccgggctggcagcggctggagaaggcgctgcgcggggtcacgtagttgctggggaagatgcccacccgctggttcagctgcccggtccaccagccctcgtcgccggacacctgcgagtccttggacagcacctccaccacgtcgcccagccgcagggtcagctcgtcctcgcccgccgcctcgtactcgaacacggccgtccagtagggcagcggcgcgtcgcagcccagctccccggggcccaccgccgccgccgcctcctcctcctcctcctcctcctcctcggccccggcccctgctccatcctcccccggcggggcggcagcggcggcgctcgctaggcagccgagaagcgctctggagggctccat

SEQ ID NO: 1167 - DNA, 29662 bp, Homo sapiens
taagattctgaacttttattttctggcatgaaaagtacaaataattaaacaattccatgtaaaagtctgttaccgcggccaggcctgtgatcccggtaataaatagtctaaacgcaacgcgaagtgttcttgttgggttttttttttttttttgtcttttgttttgtctttttttttttttttttttttacagttttttatcacctccaacatggactctgtcgtgatttgaaaccttccgaataaataacaggatgaagggaggggtggaggggctgagccccctcccccctggcctggcccctgccccccagggacgtggaagccccaagtccccctcgcctgggagccccggcctggccccctgcggggaggggctggcctccagggagggggcctggctgggctgagttttgtgttttagaaaaagaagtcccctcccagtcttgggggtggcaggggcctaggcctcggtggggggggggtgtgtggggaggtgccccctctctggagcctggccccccccagggtgggggacaaacccagcccttattgctcggacgccctgctgcaagcttcccacgcggacgtgcgtgttcccgaatgcagagggcggaggggagagagccccaagagacagcaggggagaggggtccctgccctgctgcaggggagaggagagagggcagggaggacttaaaaccacgagaataaataggttcgtgtatcaagaacaagctagggatttcaccagctaaataggactgaaaaaattctcaagacaagagcaaaaagaatcccattggtgacctggacgtcgctggccgtggggactgtcccgcagagcacacgcccccgcgtgccactcggctaccattactgttattaataattattattactttaatgattccacttccccttttataaataaattaggcataaccatgtctcggcaaaacttaaagaaacaaagagaacattgtcgttcctttaacttgcaaaccggatgaagtaacagaaatatacacggatgtccttacagggcaacgaggagaataaatagttaacatagcaataagttaaaactacaagaagctaaattcagcaaaaaagtacaagaaagttaactggtgccagtttatgtcttttttttttttccttttttttttttaaatctcttctgtgtgttttctttttttgttgcttttttttcctcttctgtttgtgtttttttgtcgcttttttgatttttttcttttttgttccttgcagcagaagctccacagacgtttaataacaacaccgggaggggtgggggagagagagctggacagtcagatgggggcgccatagccagacaccaaacgtggggacaccgggggaaggcaacttaactatagctaaagtcgggggttttgcaattctcagttccgatggggccgctgagtggggtggggagcggtgcgagggctcccaggggctccggcctgtggcttctgttggaattttttttttttaaagaaagaaaactagggcgatgcaatgtccagacagaagccgggggccggggctcgagatcgggggctgtgtccactgcaatctggaaagacgaaaaacccaacaaaccgaaaggggataggtaggtgacaagtggacgggaaaggagtgtggggctgggcctttgggcccatccaccccaccctgggcctggcggggagtgccggggtcttgctgccggggaggcccagtcctggtgggggaggctcagggctgggcctctccctcagctgtgtgggccaaggcctcggcccagggggaggctgagccccggggacaggggtgtcctttggcctcaagtgttgtgggggggggggctgcctccagcccaccgtgacgccaaggtggaacgaggtatcgtgtgtctcaatgcatgtgcgctgcgtgtgcacgcctgtgttcgtgggcgccaaggagaccgctgggggtccaggagagatctctgcagagaacctgggggccagggcgagggggccgagagggtgagggagcgtctggggcagggtctggggtgggacctcctgcctgggcctgtgggatgctatgggcatatgtctgcgtgttcctgggtggtgtttgtgtttctccgtgacctggtgtccaaatttgatgtccaaatatctatcgctacattcacgtgtgcacgtggacaggtggatggattcgtgtgcccacatctgtggtctgtgtccacatggacgtagccccagcttctgtctctttctgtctatccctgtccacgtgtctgagtttggccaaccagtcccttaacgtgtctggggcatgtcgctgtgtccgtctgcgtctgtccgtgtgtccccgtggtgtgactgtctgcgtggttgtttctctgtgtggccccgtgggctgctagcccctaagccctgctccctgggccccccccacccccgccccagttggtaaacataacctgccaaaatattttctttttttttttttgtctttttttgtgtttttttttttcaagttcaagaatccccagtaaaaattctccacgaggtctttttccctttttacaaaaatagagtttttcttcccctcccacccccctttttttttcattttgtttctgcttccagccccactgcctgctcccccgcattccaccagggggcactgggccgggggtgcccacacccctcctcacggttcgcttttttggggatttttaaacctgttcctcctaccccaggccccacctaggtgctggggaggcctgggcaagggggtctgggagggcaccccctggagccccccaagccatcccatcgggggtggtcgagggtgggggtgggggcacatctctgcattctttttagccgaaaaaagaaacaaaaaccttcaccatgaaccaaaccaagacgagagagtgaacagcccagcctggggtgggggcaggaggatggggcgggggatccccgggcacccccccaattccctgcagaccctcccaccccagagtgctcaccctgtggcttccgcagggacgtggggccctcgcgtcgtccgtggggctgcctgtgctgtctctcttgggccccttctctctctctctctctctttctctctctctctctctgctgcccggggagggggtgggagggcaggcggggtgggctcacgccttgtgctgtttgctggtcttgaaggagacctgcagcacgcgctcgcccaggcgatagccgttcaggctggcgatggccatggccgcctcgtcatagttggtcatggtcacgaagccgaaacccttgcacttgttggtggtgaaatcacggatgaccttgacgttggtgactgccccaaaaggcccgaacagctgccacagcacgctctcgtctgcctccggtgacaggttgtacacgaagatgcaccagccggcgcccgccgcgccccccgacaggcccacgcccgccaggccgctcataccatcgatggcgatcggcgagaacctggcgatgagcgacaggggactactttgggggtcacgcgggctctgccctgaccccccgcatgcttctgaccccgttgtgacccttcacacctttatgacccctgactgtgccatgaccttggaatggtgtgacccctgcaatgcaatttttttttttagagacacggtctcgctctgtcacccaggctggagtgcagtggtgcaatcatggctcactgcagctttgacctcctgggctcaagcaaacctcccgcctcagcctcctgagcagctgggactgtaggcaggcgccctcacacccagctaattttttttatgatttgtggtgacacagtctcactatgttgcttaggctggtctcgaactctcaggctcaagcaatcctcctgccttggcttcccaagtagctgggactacaggtgcaccactatgccccactaatttttttttttttttttctgagacggggtcttgctctgttgcccaggctggagtgcagtgggatgatctcagctcactgcaacctctgcctcctaggttcaagcgattgtcctgcctcagcctcccgagtagcacctgccaccacgcccagctaattttgtatttttaatagagatggggtttctccatgttgatcaggctggtctcgaactcccgacctcaggtgatccgcccgcttcgacctcccaaagtgctgggattacaggcatgagccaccgcacccagccatgccccgctaatttttaaaaatttttgtagaggtggggtctcgctgcgttagccaggctggtctcgaactcctgggctcaagcaatcctaccaccttggagttccaaagtgctgaaattacaggtgtgagccactgcacccggctttccttttcaaatcatatatttattatcatcaacttcatcttccctgcaagagtttgttccagcccctgaacaacacctagtaagcacttgggaggtgtctgttgaatgaattaatgaaaggacagaattggctccactcacattcctcactggcaatcccgcccttggattaaacccctcagctgggaagggaggacccaagggcctgaaccattcaatcctgaccacgaggaacaaactactcgctccttctggccctctttgcacaggcttttcccactgctaggaactccctttccactctgcctttgtgtggatgttgcctcagatgggactggggggtctctgctgctgggtctccgtcaccccttcttttttttttttctttttgagacggaatctcactctgtcgcccaggctggagtgcagtggcacgatctcagctcactgcaacctccgcctcctgggttcaagcagttctctgcctcagcctcccgagtagctgggattacaggcgcctgccaccgtgcccagctaaatttttgtatttttagtagagatggggtttcaccatcttggccaggctggtcttggactcctgacctcgtgatccgcctgcctcggcttcccaaagtgctgggattacaggcgtgagccaccgcgcccggcctctgttaccccttctacttcacagctttcatcaccattcatttctctgtctcctcccccactagactcagactgagatcttcttttacattttttaattatttttttttttttgagatggagtttcgctcttgttgcccaggctggagtgcagtggcacgatttcagctcactgcaacctcctccttccatgttcaagcgattctcctgcttcagcctcctgagtagctgggattacaggcatgagacaccgcgcccagccacattttttaatttttggagataaggtctcgctctgtcacccaggctggagtgcagtggcaccatcatagttcactgcagcctccaactcctaggctcaagcgatcctcccgcctcagcctcctgagtagcctgaactacaggcatgcaccaccgtatcaggctaatccttaaaaaaaaattgtagagaaggatctcactatgttgcccaggctgatcttgaactcctggcctcaagtgctccttgcccctcagcctcccgaaacactgggagcacaggcgagaaccaccacgtctggctttgatgtcacatctctcaatggccatgctactccaagacccaggcaaacaaggctaagcctgcagccctgggggtgagctggggaggggtgcatcaggggcatggatggtgaggggtggggacagtggggcggggtcactgttacctcttgacgccgtaggccatgttgagcaaattgtccagcctgtggaggcagaggtggtggtcagaggtggcttccagtcacgcccccctgctgtgacaccgtcggcctgccctccccacccccacccaacaggcctgcagcagagccctgcccccgcctgcctgctccccgcccgcccggctagacactgcctggcacggaaccgtggtcactcaggcaccgcctctcgcctgccccaccgctgtccagcctgcactggcctcctcatccatcctccccctcctggctggcgggtcccctctgggcccaggcgctgggatccctggggaaagataactcctaacaaaggcgacagtaactaccacagccaacattctcgcagcacttgagggggtgggtaacttgccccggccacccgggggcccacaaggggcttccattgtctccccttggagtggctatgagcttggactccaggtcctgggtttgagtctctgctctgtttgggccaggcaaaccccaacacctctctgtgcctcagggtccccgtccataaaacagggacaacacaagctctgttctcatcgggttgcagaaaaataagggtgtctagcacacagcaaagactcatgaaatatttggtgttattacagatgggaaactgaggcacagagctacagccacgtgcccaaaagagaaaggggccaccagagctggaacccagatgacgccaaaatcttttaacaccaagaatgccaatcgtcgcggccagcacacattgagggcctgctgtatatgagtggctggccttggcacctgacagataggctccttggctcccatgtgtgcgcaccctcccggcatccctcccttcggcaggaatggggttcagggagggttgcaagcttgggggcacccggcctggggccatctggctggcagggggctcaccggaaacgctgggtctgatggtgtagggggcctgcgtagcgccgggcggatgactggtagaggtgggtgagcagcgcctgccccgtcttctgacttgggttgttcgcgaacttgactgtgatgggctcagctgcgcccagcggcttctgcccattcagtcctttgatagcctcttcggcctcaatcctcttgtcaaagcggatgaatcccacaccccgagagacacctgccagggggcagggatgtccatcacgacgaccctgtcccctcctgtgtaaccccacttctcccttccctgcttcatgccctggcatcttggtcggtttccccacgttggtcccacctgactgcctttgcccagcgcccccgccaggtgcaccctccctgactgcctgacctgtgacctggtccaccaggatgcgggacgtgatgatgcggccgtactgggagaagagctgctccatctctttctggctcatggtcttggggagcccgctgacgtacaggttagcatcccggatggatgctgaactgggtctggcataggacacctgggtgagggggtcagatggacaggggtgaggcagagacccatttcacagatggagagagtgaggccatgtctaaaccatcacggagttagcagaagtgacccatccgtcactcaataagtatctctagagttgtcaccgtggggtggggctgagtcagatatgggagaggggacatggcagtggctgtaacaacttggactgcctgtatagagtgatggggacctgccacctagggaggacatgtctccctggggtgacatgtgaccccaaagggatccttgaatagccggctcacatcactatcacatgcttgacagtccatcaacaaacattgacctttttttttttttaaagacaggatctcacttttttacccaggctggaatgcaatggtgtgatctcagctcactacagcctcgacctcttgggctcaagcaatcctaccgcctaagccccgcaagtagctgagactacaggcgcccaccaccacgcctgaccagcattttttttttcttttttttttttttgagatggagtgttgctctgtcgccaggctggagtgcaatggcgacatctcggctcattgcaacctctgcttaccgggttcaagcaattctcctgcctcagcctcctgactagctgggattacaggcgcccaccaccacgcctagctaattttttttttatttttttgtatttttagtagagacgggtttcaccatgttggccaggatggtcttgacctcttgaccttgtgatccgctcatctcggcctcccaaagtgctgggattacaggcgtgagccaccgcgccttacctaatttttataattttagcagagacagggtttcatcatgttggtcaggctggtctcgagctcctgatctcatgatccgcccgcctccgcctcccaaagtgctgggattacaggtgtgagccacctcccccggcctcagctaatctttaaatttttttttttgtagaaacaggatctcactgtgttacctaggctggtattgaacttctggcctcaagcagttctcccatctcggcctcccaaaatactgggattataggtgtgagccaccatgcctggcctatttttattttattgaaagacggagtcttgctgtgttgcccaggctaaatgcagttattattcacaggtgcaatcatactgcactgcagcctccaactcctggactcaagccatcctcccacctcagcctcccaagtagctgggactacaggcatgcaccaccacacccagccactcttcccactcctatagagagtggacctaagacactggccccttctcttcccagctacactgggccccccagggacactcaggtctttagtcatcagctcccaaatgtccccagtctgcacccctggtggcaactgcatccaggtgccccacatgggggtgtcaagggcacttcatacacagcacgggtgcctcctgctcccgcccgcctccaatctgccccaactcactaatggcaactctgtcctcctaagtgctcatgtccccaggttcaggttgttctcgacacctgttcttcacatgcacatccaacccactctaaatcctgtaggctctaccttcctccttatccagaatccacacacttcaccccactgccactgtcccaccctggcccagccttcactactgatcacctggaccagtgcagcagcctccaccctggccccccctgctcccatcccccactgtctgtcccccctacggcagccagagggcgcctgtgaacacctgagccaggtcgcatcccccctctgctcagaaccctctatggctcccaccttcctcagcagaaaagccaaagtcctttccttggaccgcaaaaccctgcacattcttccccatgacatccttgccctcatctccccctacttcctgccccaattactgtgttccagcaacttgaacttcccccatttttcccaaacacaccaggcatgtctcagcctcagggccctggcattgcctgttctctctgcctggaatgctcttcctcctcttctttctttgggtctcagttgaaacatcctccctgtcctctctcatctaaatttgtcctccccccaccacccctattactctttctcaaagcacttctcctaactaggaattagacacattttagcactgttatctgaatcacattattaattatagtccaacccaacaacgaaactctctgcaggtgtttaaaaaaatggtgggtcaggtgcagtggctcatggctgtaatcccagtgctctggaagttcaaggcaggaggatcaagggagcccaggagtttgagaccagcctggacaatacagcaagactcacccccgtcctccaccgccacaacctctacaaaaaaaaaaaaaaaaaaaattagctgggtgtggtggtgcacacctgtggtcccagctactcgggagactgaggctggaggatcacttgaacccaggagttaaaggctgcagtgagctatgatcacaccactgcactccagcctgggctacagagcaagaccctgtctctaaaaaaaaaaagagaaaaagatggacatatatatttatttcccagaaacggtggtgactggtgagtattgtaaaatgggggacagaaaagtctatttacaaagcagggaatattgtgtgaccttgtttcattgtgtgtttatcaatgtcctggaagcatggtagggaagtccacctctcaaatgctcagtgggtgacctgtcaccagggactggggaagaggctggggcgtggtcatcagcaattctcccccttatgtctgctgtatctatttttcctccctccctccctccctccctcccttccttccttccttcattccttccttctttccttccactctccctccctccctctttcctccctccctccttcccttccttcctttcctctttctttttcttgttaagtgaggtttttgtttgtgggtttgttttgagatggggtcttgctgtgttgcccaggctggagtacagtgatgcaatcatggttcaccacagccttgacccccccgggctccagcaatcctcccaccctcggcctcccaaagtgctgggactacaggtgtgagcctttgtgcccagcctctattttctgtttcttctaattaacctcttgatagataggggtcattgtcttctggcttttgtttgggacagtgagttgagacagtgagttgtgagagtgtatgcctccattagaaataactaattaaagctgggcgcggtggcgcacgcctgtaatcccagcattttgcgaggctgaggcaggcggatcacaaggtcaggagatcaagaccatcctagctaacatggtgaaaccccatctctactaaaaatacaaaaaattagccaggcgtggtggcgggtgcctgtaatcccagctactcgggaggctgaggcaggagaatggcgtaaacccaggaggcggagcttgcagtgagccgagatcgcgccactgcactccagcctgggcaacagagcgagactccgtctcaaaaaaaaaaaaaaaaaagaaataactagtttaaaaatgaacaaaatagataaagcagtttgagagtgaatggggggcagggtctgattaatataattttgtgcacctggggttctccagaaaaaaaaatcacatcagccattgtcatgtccataataatgatttttaaaatcacagccaggccaggcacggtggctcacgcctgtaatcccagcactttgggaggccgaggtgggcagatcacttgaggtcaggagtaggagaccaccctggccaacatggtgaaaccccgtctctactaaaaatgcaaaaattagccgggcgtggtggcgggcgcctgtaatcccagctactcaggaggctgaggcaggagaatcacttgaacctgagaggcggaattgcagtgagccgagagcgcaccactgtaatccggcctgggtaacagagcaagattccatctcagaaaaataaataaattaattaagaaataaatcatgtccatgctgggcacggtggctcacgcctgtaatcccagcactttgggaggcttgaggggggtggatgatctgaggttgggagttcgagaccagcctgaccaacatgctgaaaccccgtctctactaaaaaaaatacaaagattagccgtgcatggtggctggcgcctgtagtcccagctacacgggaggctgaggcaggagaattgcttgaacctgggaggcagaggttgcagtgagccgagatcgcgctactgcattccagcctgggtgacagagtgagactccgtctcaaaaaaaaaaaaaaaaaagaaagaaagaaatcatgtcaatgtatttgacagttttctcttctttttttctctcccatggggctaggagctgtgagggtacttgctgatgaatcagatttgggttgagggattagatttgggggtaagatcctgggtggatattggaggtccaacaccgtctgagacacagaggaggttttcacaggccttttccatccctccatgacatgggtttcccaagggcaaggatggaccaaactccacccacaccccaccctgggatggggcctggcccgcggcaggcagctggagatattttgggcagctgccatagcgcccagtcctgactgaccgcgcaacaccgtcacacaggcaaaaacacccagggacagacagaaggccatgcagtgccgccccgctgcacagcctcagagatgaaaccagccagagggtgacacaggccactgtcacattctcagcaacgttcaggagggagtctcagagaattacagtgaaggtcgtagaaccacatacccatcacagcgcagcacaaacacacgatatcacactcaatccctcagagcagggcacaggtagacacacccacacaacatcgcggtgacacacaaacatcctgccagagccagacgcatccctgaggccccatcaggtcacagccggagtcacagtgtcacatgcacctgtcaaataataagcacgtcatcctgggccgggtgcggtggctcacacttgtaatcccagcactttgggaggctgaggtgggtggatcacgaggtcaggagttcaagaccatcctgaccaacatggagaaaccctgtctttactaaaaatacaaaattagccaggtgtggtggcgggtgcctgtaatcccagctactcgggaggctgaggcaggagaatcgcttgagcctgggaggcggaggttgcagtgggccgagatcgcgccattgcaatccagcctgggcaagagagggagactctgtctcaaaaaaaaccccaaaaaatcaaaaaaccaaaaaaaaaaaaccttatcctacagacacatagggatatacccgaagtcttaaatacacagatgcacttgacagcagcctctctctccctccctctctctccctctctctctctctgtctctctctgtctctctctctctctctctctctctctctatatatatatatatattttttttttttttagacagggtcttgctctgttgccgaggctggagtgcagtggtgaaacatgactcactgtagcctcgccgcctcagcttaagtgatcctccccactcagcctcccaagtagttgggactacaggtgcaagatgccacgcccagctaatttaaattttttttttttaggaacagggttttgtcacgttgcccaggttggtctcaaactctcgggctcaagtgatcctcctgcctcggcctcccaaagtgctgggattataggcgtgggccactgtgcctggccacagccactcgcacactgtgtcccacaaccattgtgtcacagccagagccacagtgagtcacgggacacctggatcataaacactgtatctcacaactcaagatgacacacacacaccccacacacacatacacacacacatacaccacacacaccacacacacaccacacacaccacacatacacatacatgacacacacatacacacatcacacacacaccccccacacacatacaccacacacaccacacacacacacatcacacacacaccacacacatacaccacacacacatcacacacaccacacacatacaccacacacaccacacacacaccacacacacatgcaccacacacaccacacacaaaccagacacacacatacacaacacacacaccacacacacatacacacatacacacaccacacacaccacaaacacacaccacacacacaccacacatatacacacaccacacacaccacacacacgcaccagacacacacatacaccacacacacaccacacaccacacacacatacatacacatacacacaccacacacacaccacacacatacacacatacacacatcccacacaccccacacagacacacacacaccacacacacatacacatacaccacacacatacacaccacacacatacacatacacaccacacacatacacataccacacacacatacacgtaatacacctacacgccacacacatacacacacaccacacacatacacaccgcacaccacacacatacacaccgcacacatacaccacacacatacacacacacacaccacacacacacacaccacacacatacacacatgcacacacaccacacacacatgcgtacacacacacatgcgtacacatatacatacacacatacacacacacatacacgctgcatctcaatgtcactggggtctggggtcctcatgccctgaggcttctgggtctcgttggccatgaagggacccattgggtcacaacttcactcctccaccccaatccccaaccccccacatcaggaaagggaagagattcctgcacctctgttcccatgttgaactgggggccagatgggccacccccccgaccctggcttcctccagggtccgggagcagatttgcagggcggagcccaaacacccccaggcgaacccagagaggggggtttccatgacgattcccccccagggaacctgggcttgtagggtcccagctgcagctgctgagaagggaggtcctgggggaggggcgttgcacaaagatgggggatgggccgccccaatcccgccctcccagaccctaattaggctccagatggcagatgggcccccacccccatttccatgacaaaagcagggaggggactgctcacaggaccctggtcactctgccttacagggcctggctgactccctgagcctccagagatcgtggagccagtactgtccccattgacaggtgaggaaactgaggtttagagagggaaagccattgcccccaccccagctaggaagtcttggaggggagatttgagcccctctggggatgagtcctgaaaggcagtggacatggatgcatgggggcgggtaggtggcagtagggggttggggacagtcagttggggtgggcggtcatgggggattggagaaggaggcaccaaccttgatggtcttcgtctgtaatttgaggccgttgagggtgttgatggctttgtctgcatcattggggtcagaatagttcacaaacccgtagccaaggctctgccctgtgggcagaaccagaatgatgaccttcccacccagccttgacacctgccagtgtcccacctcaggcctgagagactgtcccctccccaccaagtttccaccttcctgtttccagatgacaccttcgatgctagagtcccacctgcctccatcgctcctgagaccttcacctagggggtatacccatctccccatcagacctcacatccctagaccacctcctgcctcgattacccccgagacacctcagcaagggtcccacctgcccccatcacctctgtatttctgaggctaccacctctgttcctccccgcaactccagcagccacacctgtgatcttgtcccgaaccaacttgcaggactcgatgtcgccaatgctgccgaagagactcttgaactcatcctgggtcatgttctggggcaggtagttgacgatgaggttggtcttgctgtcgtcagtggctccatttgtaccaaggagtggcccgttgggcagggccgggccggccgggcccccccccacctgagactccatggcccccagtatctgctggagataacaggtcgcatccgctcaccgcccagtccccacaccaggggcctgcggcaatgagtggcttggtggtgatgaattagccatgtcttataggggcttcgtcatggggaggggtcactttattattctaatgatgggaataatgatgggattccatatattggaataagcattggggggaaacaaagcacctgatgtttttactgcaagaaatcccttatatgactactatatacgcaaacagaggcctaaaatcaacctgtgcatttacaaaataaaaaacgctttcacaccggaaacgctttcacgtcgggcgcagtggctcacgcccctaatctcagcactttgggaagctgaggcgggcggatcacctgaggtcgggagttcgagaccagccagaccaacatggagaaactccatctctactaaaaatacaaaattagccgggcgtggtggcgcatgcctgtaatcccagctactcgggaggctgaggcaggagaattgcttgaacccgggaggcggaggttgtggtgagccgagattgcgccattgcactccagcctgggcaacaggagtgaaattccatcttaaaaataaaataaaataaatgctttcgctctcagaaaagtaaatctaacagtagctttctttgtttttgttgttgttgtttgttagttggttgctctgtcacccagactggagtgcagtggtgcgatctcggcttgctgcaacctccgcctcttgggttcaagcgattctcctgcctcagcctccagagtagctgggattacaggtgcatgccactatgcacagctaatttttatatttttagtagagatggggtttcggcacgttggccaggctggtctcgaactcctgacctcaggtaatccacccacctccgcctcccaatgtgctgggattacaggcgtgaaccaccgcgtctggccccatttttagtagcttttattttagaaaaagggtctcgctctgtcacccaggctggagtgcagtggtgccatgaagtctgactgcatcctcgaccttccaggctcaagcaatcctcccacctcagcctcccaagtagctggaacaataggcgcatgccaccatgtctggttaattttaaaattatttgtagagatggggtctcactatgtggcccaggccggtctcaaactcttgggctctggtgatcctcccactttggcctcccaaagtgctgggattacaggtgtgagctactatgcctggcccttttagtagctttgaagcctcataagcccttccctaaacatatttatttgcctcctcccaccaaaggtaattcctatcccaaatgtgctaattatgtcttttgcttcatgcataagtttcttactagtcatttacctgccttcatctccccttgccacccccagttttcccactgagctattttgttcttttgcttttattgtataacataaaacaccttcaaataatgacaattttattttttcatcttcagtctatacctgttatctatttttcttgtcatttcaggggctacagtgtgatagtggcttctttattcctgattttttttttttttttttaaagacagagtctccctctgtcacccaggctggggtgcaatggcacgatcttggctcactgccacctctgcctcccaggttcaagcaattctcctgcctcagccttccaagtagctgagactacaggtttccaccaccacgcccgccaaatttttttgtgtgtttttagtagagacggggtttcactatgttggccaggctggccaggctggtcttgaaatgctgacctcgtgatctgcctgcttcagcctgccaaagtgctgggattacaggcatgagccaccacgcccggccctttattcctgctgttaagggagatgctttaaacattttgcagccaaacatgatctttgctatgggtttttttctagatggcctttatcgggttaagaacattttcttttattcctagatcctaagacttttttaaaaaaggatgttgaattttattgactttttttttacatcaattgaaaccattttttagctttaattaattaatttttgagacaaggtctcgctctgccacccaggctgaagtgcagtagggcaatcttggttcactgcaacctctgccttccaggctccagcaatcctcccacgtcagcctccccagtacttggggctacaggtatgcgcctccaagcctggctactttttttttctttgtatttttagtagagacggggttttggcatattgcccaggctggtctcgaactcctgggctcaagcaatcctcctgctttggcctcccatagtgttggaattacaggcgtgagccaccgcacacagcccattttttagctttaatacattaatgtcatgaattacgttaattgattttcttttttttgcgcgggaggggggacggagtttcgctcttgttgcccaggctggagtgcaatggcgcgatcttggctccccccaaactccgcctctcaggttcaagcgattctcctgccttagcctcctgagtagctggaagtataggcatgcgccaccatgcccggctaattttgtatttttagtagaggcggggtttctccatgttggtcacactggtctcgaactcttgacctcaggtgatccacccgcctcagcctcccaaagtgctgggattacaggcgtgagccaccgtgcccagccgttaattgattttctaatattaaatcaatcttgatgggataaaccaaacttggtcatgcatattgcagttttgtttatatacattgcttgatttaatttgctgaattttttggtggtttagcatttttttacatatatgttgaggaggacatgctgtttatttaattcacacaaagactctaaaatggtagaagttggctgggtacagtgacttacgcctgtaattccagcactttgggaggccaaggtggacggattgcttgagctcaagagctcgagaccagcctgggcaacatggcgaaaccctgtctctactaaaaatttaaaaactagctgaatgtgatgttgtgtgcctgtagcaaagatacttgggaggctgaggtgggaagatcacctgaggtcgggaggtcaaggatgcagtaaaccataatcacaccactgcactcctgcctgggcgaccgagtgagaccctgtctcaaaaataaataaataaagctgggggcagtggctcaagcctgtaatcccagcagtttgggaggctgaggcaggaggatcactggaggtcaggagttcaagactagcctggccaatatggtgaaaccccgcctctactaaaaataccacaattagccaggtgtggtggcacacgcctgtaatcccagctactcgggaggctgaggcacaagaattgcttgaacccgggaagtggaggctgcagtgagctgagctcgtgccattgcactccaggctgggtgacagagcgagaccccatctaaaaataatagtaataaaataaataaataaggccgggcatggtggctcacgcccataatcctagcactttgggaggccgaggcaggcagatcacctgaggtcgggagttcgagaccagcccgaccaacatggagaaaccccgtttgctactagaaatacaaaaaaaaaaaaaaattagccgggcgtggtggcgcatgtctgtaatcccagctactcaggaggctgaggcaggagaatcgcttgaacctgggaggcgggggttgcggtagctgagatcccaccattgcactccagcctgggcaacaagagcgaaactccatctcaaaataaaacaaaataattaattattaaatggtataagttaactttgctatgatagatggagaatctgaggcttaaagatgttaaggaacgtgctgaagtcacatagcctatctgctctggcattggaaatgaaatgaagaccctcggaatgtgaagaccactctacaattttcttttctttttttagagacaggatcttgctttgttacccaggctggagtgcagtgttgtgattgtagttcactgcagcctcaaactcctgggttcaagcattcttcctgcctcagtctcccaagtagctaggactacaggtgggcgccaccatgcctggctaatttttaaaaatttttttgggctagacgcagtggctcatgcctgtaatcccagcactttgggaggccgaggtgggcggatcacgaggtcagagtttgagaccagcctggccaatatggtgaaatcccgtctctactaaaaatacaaaaattagccgggcatggtggtgtgcgcctgtaatctcagctactcaggaggctgaggcaggagaaacgcttgaaccagggaggtggaggttgcagtgagctgagattacatcattgcattccagcctgagcaacagagtgagactccatctcaaaaaaaaaaatttttttttttgagccaggcgcagtggctcatgcctgtaatcccagcactttgggaggccgaggcgggtggatcatgagttcaggagttcgagaccagcctgacccacgtggtgaaaccccatctctactaaaaatacaaaaattagtggggcgtggtggcacacgcctgtaatcccagctactcaggaggctgaggcaggagaattccttgaacctgggagacggagtttgcagtgagctgagatcgcgccattgcactccagcctgggcgacagagagagactctgtctcaaaaaaaaaaaattttttttttgtagagatggggtgtcactatgtcgcccaggctggtctcaaactcacagcctcaagcaatcctcatgcctcagcctcccaaagtgttgggattacaggcatgagccactgaacctggcccaattttcttactgtaacagtcaaccaggctggtactggctctgacaactcactatgcgtctttggatatgcctgctagggcctctgtttcactttgctgaaaattcagaacaattggcaagggctatatgaagggctatgtagaggagaattttaaagccacttcagaaatcagcagcaaacagtgctgggatttgactgaccttatctgtcagggacataagaaggtcaagtagccagcatttccttacatcttcttcagtggcacagttggcacataggtttaccctcacttgaaaacctgaactgggccaggcatggtgggtcacggctgtaatcccagccagcactttgggaggctgaggcaggtggatcatctgaggtcaggagtttgagaccagcctggctaacatagcgaaactgtctgtactaaaattacaaaattagccaggtgtggtagtggacgcctgtaatcccagctactcaggaagctgaggcaggagaagtgcttgaacccaggaggcggaggttgcagtgagccaagatcgcaccactgcactccagcctgggcgagagcaagactccgtctcaaaaacaaacacacatactgattggtagtgtcttcctagaggaatgaattaagaagaattcagaaaccacatttaggcaaggcgtgctggctcatgcctataatcccagtactttgggaggccgaggtgggaggactggttgagctcaggagttcaagcccagcctgggcaacacagtgagatcttgtctctacaagaaatttaaaaattagctagtcatggtggcttgcacctgtggtcccaggtactcaggatggtgagacaggaggatcacttgagcccaggaggtggaggttgcagtgagccatgatggcaccactgtactccagcctgggcaacatagtgagacactgtataacaaaaaagaaaaagaagaagaagaagaaggagagggagagggagaacgagaaggagaaggaaaaggagaaggagaagaagaagccaggcgtggtggctcacgcctgtaatctcagcactttgggagaccaagggggggtggatcgccagaggtcaggagtttgagaccatcctgaccaaacatggtgaaaccccgtctctactaaaaatacaaaaattagccaggtggggtggtgggcacctgtaatcccagctatttgggaggctgaggcaggagaatcacttgaatccgggaggtggagattgcagtgagccgagatcacaccattgcactccagcctgggtgacagagtgagactctgtctcaaaaagaaaagaaaagaggcagggcgcggtggctcacacctgtaatcccagcactttgggaggccgaggcgtgtggatcacgagatcaggagatcgagaccatcctggctaacacggcgaaactccgtctttactaaaaatacaaaaaattagccgggcatggtggcgggcgcctgtagtcccagctactccggaggctgaggcaggggaatggtgtgaacccaggagacggagcttgcaatgagccgagatcgcaccactgcactccagcctgggcgacagagcgagactccctctcaaaaaaagaaaagagaaaagaaaagaaaaagaaaaagaaatcacatacagttttcagtaggaaagatcactgtgattgattagcaatgtctgctgtggccacacaactagaaacagccagcaggtacatattatctcaaccatccctgactcaagctccaatatcttaattgttcccaaatattggctactactgtgtgccaggcactgtgcaaagcactctacatgcaagttttctgttcttattcacaacaatcctaaaaagagaatttttcctcccccacttcacccccacttaatacatgaggaaactgagatattttaaaaattgccaaagatcatgcagcatataaatggtggaacagggatttgcatatgagtttttctgatccagagtgtgcatttccaacttccactgccaaccaagaacagtgccagctctaacatttcccagctgtgtgtcctcagatagactacttagtgcttctgagcctctgctccattttgctgcaaactccaaattatagtcacactggcctggggtagtagctaaagccatatgctgtaaagcatctggaattggttagttacgtctgtcatgggcatgatcatgggaattaaaagcaggcttgtcacatccatcatccgtacctcataatacacctacattatttattattattattagagacggggtctcgctctgtcacccagactggggtgcagtggtatgatcatgactcatttcagtctaaacctccggggctgaagtgattcttacacctcagcctcctgagaagctgggactacaggcatgtgccaccatgcctggctaatttttttaattttttgtagagatgggttcttgctatgttaccaggctgatctcaaactcctggcctcaagtgatcctcccaccttagtttcccaaagtgctaaggattcagttgtagccaggcacggttgctcacgtctgtaatcccagcactttgggaggccgaggcaggcagatcacgaggtcaggagttccagaccagccttgccaacatggtgaaaccctgtctctactaaaaatacaaaaaaattagccaggcgtagtggtgggtgcctctaattccagctactagggaggctgaggcagaattgcttgggaagcagaggttgcagtgagttgagactgtgccattgcactccagcattgcacaccagcctgggtgacagagtgagactccgtctcaaaaaaaaaaagaattcagttgtgagccaccatgcctggcctattattcttttatttaaagatggggtctctctatgttgtccagcctggagtgcagttattattcacaggtgcaatcgtagtgcactgcagcctccaactcctggactcaagcaatcctctcatctcagcctctcaagtagctatgactacaggcatgtgccattgcatggggcaatactgctattttattttattttatttttttgagacggagtcttgctttgtcgcccaggctggagtgcagtggcgcgatctcagctcactgcaactccgcctcctgggttcacaccattctcctgcctcagcctctggagtagctgggactacaggcacccaccaccacgcctggctaattttttgtatttttagtagagatggggtttcaccgttagccaggatggtctcgatctcctgatctcgtgatccactgcctcggcctcccaaagtgctgggattacaggcatgagccaccgcacccggcctaatactgctattttaatgagcattccactacactgagcatctactgtgtgccaggcactgtgggaaatactttgaggcatattttcagttactctcccaacaatcttaaaagactgagaacacattctccattttacaggtgacaaaagtgaattcagagacgtatgaatagggaaattcatttcagtcctggatctgtttgcagagctgtttttcatcattatggccaatgccttgtctcgctatgttgcccaggctgaccctgaactctcaggctcaagtgattctctcacctcagcctccccagtagctaggactacaagtgcaattcatcatgcccagctaattttttattttttgtagagatgggatcttgctatgttgcccaggctgttctcaaactcctggtctcaagggatcctcctgcctctgccttccaaagtgttgggagtacaggcatgagtcactgcacctggtcaccatctactttttttttttttttttttgagacagagtcttgctgtgtcacccaggctgcagtgtagtggcacgatcttggctcactgcaacctccacctcccaagttcaagcaattctcctgcctcagcctccgaagtagctgggaccacaggcgcgcaccaccatgcacagtgaattttttgtatttttagtagagacaccgttttgccatgttagccaggctgatctccaactcctgacctcagatgacctgcctgccttggcctcccaaagtgctggtattacaggcataagccaccacgcctggcccatttactcttgtaaaacagatggcacagaaggtcagctcccctgcatctccaattggctgagttgctcctgggagggctgcctggaggactactctgaagacacatccggcctcaaaaggaatatgcattgggttgattagcaatgtctgcaaggcacccgcagtgatgcagtaacatgcactgcacagctctgcattcccgtctcctaacattaatacttaactgatcgcgtaaccatgtattgaggtgcctgttgtgtgccaggaaaaattcctcatgtgaaacttccaggtggttctcctgccgttgaacatgatgagattcctttctccatttaatacacgaggaaagagagtctcaatgaagggacagggtgactggggaggctgagacaggaagatcatttaagcctaggagtttgagagcagcctgggcaacacagtgagatcttgtttccaccaaaaaatttccaaaaaaattagctgagtgtggtggtgcatgcctgtagtcccagctacttgggaggctgaggtgagaggatcaacttgagcccagaagtttgaggatgcagggagcgtgatcatgccactacactccagcctaggcgagagggtgagaccctgactcttaagggaaaaaaaaaaaaatgaaggaataggaacagagttgcataggcggcaaatggtgaaacaagaattcaggctgggcttggtggctcaggcctgcaatcccaatactttgggaggcctaggcgggaggatcacctgaggtcaggagttcgagaccagcctggccaacacagcgaactctcatctctactaaaaatacaaaaattagccaggcatggtggtgggcacctgtaatctcaactactcgagaggctgaggcaggagaatcacttgaacctgggaggcggagcttgcagtgagccgagatttcaccactgcactctagcctgggcgacagagaaagactctgtctcaaaaattagaaaaataaaataaaaaataaaaaaaaaagaattcagttccagggtttggactttagagcccactcccctaacgaaaagaccagtaatataataacaaaataataacagcaaagcgaagctgagtacctgctctctgccgtgccctgggcatcatgacatttaaacccactccatcggttgagtctattaattcaattcaacaaatatttactgagggctacacatgtcagactccaccctcctcatgctgtcctctgatagttaggtcacctctctatgcctttctgttcttccttaaggaaggtatggcacagaggtctcacatgtatggagctggattctgaatttgcatcctggttcattaagagttttgtggggtttttcttttccttgtttatttttgagacagggtcttgctctgttgcccagtctagagtgtagtggtacgatcatggctcactgaagccttaacctccttctgcctcaacctcccaagtagctgggactataggcttgcaccacccagccggctaatttttctctttttctgtagagatgaggttttgccatgttgcccaggctgcgatcctcctgccttagcctcccaaagtgctgagattacaggtgtgagctccaccatgactggccctggagatggattctgaatttgcatttaagctcattgaggtaagagttctatgttgagttgctgatatttgctataagagcccagtgagcagttggcagtacacaagccactgcttctggacatgctagatccctatttttttttttttttttttgagatggagtcttgctctcttgcccagcctggagtgcaatggcatgatcttggctcagtgaaacctctgcctcccgggttcaggcaattcttccacctcagccaggtagctgggaccacaggtgtgcaccatcgcgccccgctaactttttatatttgtagtagagacggtgtttcaccatattggccaggctggtctcgaactcctgacctcatgtgatccacccaccttgggctcccaaagtgctgagattacaggcatgagccaccgtgctagatcctatttttgaactccactgagcatgtgcaaagttttcattgacctcccacaaccacagtgaatggtatgaagggtctcctccatttctcagatggggacactgagggttagtcacagggacctatgacttgtccagggtgacaggaggaggtggaggggatggtgtcaacatctgactcctgatccgatgaccctagagccgaaagagttactggctgcccccctcccatggtgtccccaacctgagcagagtgaagaggtgactgggtggttcagacccaggttcttgaggcctagcctgctaatctggccaccacccgttctccctcccatttgtgccagagcttagcgggaccagtatctcgtttcctctgtggctgagccggctgagctgataatggggatcagattgatggaagccacacccgccctgccccagcctgcagtaagtgcacagcctgggatggtggctacatgggcatcaaagggacttcggcgactggccccagacagagatgggggggtggcaaagtcagggaggaggagggcagataaaagatggagggttagggaagcttcccattctctccagtgcttcttctaagtctcccccgacttttggtttctctctccctctttcttcctctgtttccctctcttctccactgtcctgccctctctctgaaccgttctgtgtccctggcctcatcactctctcttcctcttttccaccatcgcacatacatctgacgtatgggttttgcagtgaacacacctgaggccacttttttcttaaaacctcctgtgtctgacccccacggcccccagctgcggcccctggccccagtcacagtgacagatgcctggataccggcgacaatagggcattgagtggctatgcatggtgaggctgggctaccacgtggtgctgactgagcctcctacttctgggcccttcttcaatgcagggtcctcctggtcttaatttgtcacctctcttcctcccagcctgtccccatgatacatctctgccccagggctcgctcactggagaacctaggtcctcaaggcccttgtgtgacctctgaccacaccctctttccctttgtgcattagtttcctttttcaaatgagagaaccgatcagaggacgcttaggagatgctggactgttgcgggagttctgaggtcctcaggaggccacactccagttcccagacctgggtgaacagcacgaggcccagagagggaaaggaacggcctgaggtcacacagcaggtgagccaggcctccgggacctcatttctcagagccaggtgggcgggtcccagggtccaggaggggagaggcttaggcatggagggagcgccaatcatgcccccacccccagtgctagccacgactcgaaaaaggggcccggaaagagacacaatgcacagagacacacacgcagagacggagagataggaagagtggaagagggaggcccaggcgccgggaccagacaaaggacgcgcggcggcgcggggagcggagtcgcgcggcaggggcgggggtggagccggggtggggctataactggccagccccgcccccgggatacgcccgggctgccgagtgggaatccgagggctcgggcgaggccgggcccccggggccctgggggcggggcctagatgggcgtgcccgggcgtggccaggcagggcgtggcagggcgggaggggctgcgcgctcgggagctgaccagctccgtggctgctgaaagcaccgagcgcggggctagcggtgcgggcgagcaggcgggcgggccgcgctcaaggtcacctcgcggcccagagccttggcgaggtggggagcctggacctggcctaagggggctgtctcggcctcccaccccatctcccggggggcggagacccgggagcccagaggtgcccccccaacccgcgggccctcctctcccctccccctccccgcagcccgaggcgcccgcgcgaggctgcggcccgcgaagaagcgccgagaaacaaagggacgcggcagcagcggcggcgggcccgcggggcctccgggcgcgccccctcctctcccctccccgcttgccgcaaggtcgacgggctcgaggacgagacgcccgcctcccgggtgcggccgaggcccggggcgcgcgatccgacgccacccgctttcccagggctctcggggacgctttgtcgctttggcttggcccagcaccagtgatcgggccctgcgtttgcctgggcggcctgcggggtctgggcctggatggaggaagcatccttagccgccgcggcccctcccccatcaggcctgctggagagggggcaatcccgcctccagggcggcgtcggacgcctcccgaatcgcagtcagtctccctaaggccctctcagaccaagctctaagcgccctcagcactctgggcgcggccctgcccactctcaggccccgaggcttggtcctacccccccaacccgggcctagctaggcctggtcctaccccccccgccgcacccgcccaatctccgcggagcctgggcccaactcctccccgtcccgattccctttcggcgacaggggaatacctacagtgaccattcttgtgtgcccggcgggcgcggtccgtgttgaggggggctccgggggtggtgcactcctaggggggcgcccgatgctcacgctggggtcccgcccgggcggcctctggtgcggccgctgcagatgtggcgatgaaggcggcggctccctcgagggccagggacgggcccgaacccggggatgcgcgcgcggatggccgggccccggggtggcctgcgggcggcaggggatggaaagagggagcgggcgcggggttgaggacgccccctgcgcggccccgcggggcccggggaggttgcgcttcccgacagagatcgcggcgctctgcctttcgccgccgcccctcggtcggtcctgtccggtcccgtgtgttcaagtcc

SEQ ID NO: 1168 - DNA, 29662 bp, Homo sapiens; identical to SEQ ID NO: 1167

SEQ ID NO: 1169 - DNA, 76403 bp, Homo sapiens
agagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccggggtaaggagagggaccccggggagggcaggactgcagaagatcccttttctttcacgtccagcccgacgatagcaggaggtcagggctcttggttcctccccacacttttctgcaagatcttagagtctgggggtgcagagatgctctttagaggtcacccagtgcatccccccgccttcgggttgctcgacacctccggggtcttgctgcaagagggagctcctaggaagcctgttggactcccgcgctccaggtgtttcacactcaccgcagtgcagaggaaagagccccgggcttctggaggtttgagttccagccccggataattagcagtttgaccttgggcaaagcagtttttctctcagggcttcagtttcctcttccgtacagtgcaagggatggagtagactatctttaaggtcccttccagtgctaacatttgcagtttcaaaaccttttcccggatttccttcatacgtcttatgtgagtcccactgcagtccttcccatgctgtcgtctgaggaagaacagcgaagcttttcgtcctggcaccagggtgatgagcccgcagtgacgtggaagtggcttccaaaggtgccacctcggtggcgattttcccatttccctttggattctccttggcacttcttacttcagactgcagtcactccccttccccagatctcagccgctcctcccaagcccttactgccccccacctccccgcttgctttcttctcatctcttcttactgaccttccttacctccatccacagggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctggtgagttttaaccacccctttgcccaccaacggggcgtggcttgtaggggagggcaggacttagaaacttctccaagtttcaggtggcgagctgaatccaaagttgtgggaacagaattgttgggttcgattggaatctcagaggggtggggcagtggaggtgggaaagtatgtggaattgagaagacagtgggtttactgtggagtaagctgagttgatctgattcagacttgggtccctggcctcatcctcccttttgggagcttggagtgagacccaagtttaagtaagtagttcgttgagatcatgtgagcttgtactagttgtatagtagtactcagaaggcgttatgaacattgtgattgggctctgactctgaccttaatacatattattgaccaatattaaagagaaaggaggaagaaatcaacatttttttctgcatgtgaggtgtgccagtactttgccatgtaatgttttagtgtttgagataagtattacatccccatttcacagaggaaggaactgagactgagctaggattctcacctagtctgtgactccatgctctttcccccataccaaagtgcctcccaagcagtggttacttagcttaagaggggaaaactgggagggtaccttggccaagtctcagagagggaaagcgtcagggctgcctggaaaatcctgcacaggtgctgttgcaggaatgcagggctcgtgctgaggatcaggctctaggcgggaggaggaaagaggcaggcagagacccagccacactgggccttttgtgccatgtttggacttggccaggaagtgatggagttacggggttttaagcagggaagtgacaggatctgatttgtgtgggtccctccagcagccagcacagaggatgaatagactataagaggtattgcagcattcatgcaactgatgaagctagaatgactccccccagctcctctggctcaggcttggcccctccccaaaccccgtgcacatctccccacccgtagggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaaccaggtctgggtttgtgagtcccttgggatgggaggggcagagggtggggctggttactcatgtgtgctccctctcacagagctcagtgttcccagctggatggtggggcaaacccagagacttaagtgcaaccagcctaggccccgggccctcgggaccaagccctcagagctgccggccaggagggtggggtcccgctcagccttgaaacaataaagagaatcaaagaaggtattcagggtgtggaggcaaaaaaaagcactgctctttactgagtccaaatgactcgactctgggcctcagtttcctcatttgttttgttttttgttttttgttttttgagacggagtctcgctctgttacccaggctggagtgcagtgttgtgatcgtcagctcactgcaacctccacctcctgggctcaagtgatcctcctacctcagcctcctgagtagctgggaccccaggtgagtgccaccatgcccagttactttttgtgttttttttttttttttggatttttttttacttattttttttttttttttttgagacagagtttcactcttgttgcccaggctggagtacaatggcatgatctcagctcactgcaacctccaccttctgggttcaagtgattctcctgcttcagcctccagagtagctgggattacaggcactcaccgccactcccagttaatttttttttttttttgtacttttagtagagatggggtttcaccatgtttggtctggctggtctcaaactcctgacctcaggtgattcccccccaccgccctcggcctcccaaagtgctggagttacaggtgtgagccaccgcaccaggcccagtttcctcattttgtaagatgggactggagttgacatggactgaacctgcagtccatcccctcctccatctgcaaaactgtaggtatacatacagctctttgaggaagagagttagctctcatgagcttttggaaagggtccatggtgcagaaaaggtcaagcactacagccaagaggtctcttccatatccagtgatccagtgtgatagggttgagctctccctttccccacccaactcctgagccttcactagtctattgcatccgtccccggaaactgctgcagtaaagtgtatttgattaccttggaaaaggtgggacagcccaagccagaatgcagaaggaagaagtggatactttgggcagagccacacatactcctggagccatacagggttttaacttctagacataaactttattacatttatagttgtatccctttgtgtgatatagttaggatttctctattaagtaattaatcctaactatatccttgggctgatttgatttctgcccccacccgacagactgacccttgtcccccttccccattccagctcaaggcacttaatattacaaagaaggcagtggctggctggagagatgggcctcaagtcagaaatcccccagtgcaacttaagacaaacagagagaagtcaccttcctcttaggaccctccctgggttagcagaaggaaagaacccagaagtcttcagtaccacagtaggcttcggtatctccctagccaggtgagggacccccaggcattctccctgcccgcaccgagtctctcttcaccctggctacttcctggccacacgtatgactctgccccttactttctgctctgagctgcctgaatacaggaagcaagagttcactctgaccagagatccagaagcctgcaaggaggccccagcagctttcaagaatggggagcagatggccacatgtggcctgctctgtcttatagcgtcacaagccaggagcaagcccaggggagatgctgttccatgctggcctgtataggttactttgctcgttctgttatctgtcccccatccctaacccagataaacaatacatatgtcactgaaacaagaagggattgaagcaaggagacccatgggcacagatctcttctaccttcctgagctaaaagatgccaagccaaaggaatacaggataatggcctatgtgtccaggaggccggggacaaagctctctggctttgctgggggaagaaatagctccaactacgtagtcaagaagcctgtgacagaggtgggaggggaacctcgtgaccttgaagtcacttctacctttcatattcccttctagctatcgaataggctcttttcatattcctcacaaccccagctgttaggaagaatgtggtgtcatacagtaggtggcggggagaagacacatcttcagcctagtccctgccaagcccaccaagagcaacagttagtccctagctcctccgtccccaccaagtacccacacatccatagccagagaggccacctgtctccaggacagaaaggaaactgggcatgttactcaaggggaaggaaaggggcctaaagcccagaccacagtcatagggcccagccctctagcttggaagggagagcccaggatcgggtgaaaatgggggcttgctccttaattgcgatcccccatcagctgcagcacaaaggtgaagatgtagatgatgtctgtgtaaatctgcagggcgccagtgatgtagtcctcggggctgatggtgtgcttccggttccccaggaccagctgtgtgtcgtaagccaggaactgcaaggatagggaagccagaagtgagaactcaggcatcagtgtccagagctcatttttggtcagcagatttgtcttgggggcctatgcgccacacagtgcttagggccacattaacgcacagcataacatatgggctctatactgtagctgctcacagtctaggaaaggaggcagacacaccgttctcaatatggctgactagtgttctaatagcaggcagcttgaacaagagatggcaagagtgcccacaaaaatcaatggaatctctggacagtagtgagaggaatggcctgctatggccccattccctgcctcccaggcagtctaaattcatgcccccttccctagattcctcccctcatcccctcagctccccttcctagagtggggctgggacttaccagggtgaaacaaatggcccccagagcagcatagagcatgtggagccagtaaacctggagaagaaggggacagagaatggcattagaaacctcagcaaaccacaggcccacaggccccagcttcccccgggatagtggcatgagagtgggtagagctgggaagctagctctccatgaaaggctactgcctttccagatcttggaggaaattaagactggtgatatatccagcagagaaagcagaggccatcctgcaatggctgtataaaaccaatctccaaagccagtcaaggtacacaagtgtctactatacttctagaaaaaaagcagttgagttacagctctgaaaggggcagacccagcattcaatagaccagttcctacagcccagcctgggaggggtagactaaggaagaagggaggccccccaacccctctggtgagtatcaaaatccgggagcacccacaggacagcccacatgacatgcccacaggtggccgtccacagaaggacagagctggcccatgggcaggcagccctcgtgtccccatccttccccttcggcactgttctcccccagctgaacagaataaaggaaataattggatccagagacccccgcaaggtcccttccacctaggcccatcatctcagtcctctgggttcctctcccagtctgcctccgagaacctgattctcagctgccagccagattgaacccaccccttcccctaggagtgcagtgatgcagtccagggcttcaggtgctctggctccaaggccgcccatctccacacagagagtctaccctcacccagaaggatgctgcctccacgttggtgcctttgctagccagtcgagaggttctggaggtcagagcctgccccggggacctttggggcctgcgagaccatgctatataggaagtctgccctgagcactgggttccctgaccccagctctcctgggacactcacgtattggaagtagagcacaatgctagtgacaatcccagtcaccaggagcacaattcccaggacacagaagaggcctgtgcacgaggtgaagtccacctgccaggaagcaagaaagaggcacctgtcagatggctgtgacaaccagcccagtcagactggccctgccagggagtcccagtgctgcctcctagggggtatgggaatgtccacaacattctaaggacagaaacaggacacagttttgtaggtgcggatgaggagaaggggatcaggtctctagggaacatccctagtgtgccggggtccgggcctgataagaaaggggagtcggggggccagggaagggccctccatgccctcaccttggtctgaaagcagaagatggtgactgaaatggataccaccgcagtgatgatcattgcaatgatgacggctttggtttggtacatactggggagaagcaggagttacagacaagaggcattaagccacgtatgaatgacttcaaaatcaccacttccagaggggacctgcccagaatccacccacgcagctggctgccggcccaggaacaccccactccccacaatacacatttcccaagagtggtgctttatccctgaatgtacctggaaatggtgcccgtcatgaagcccatggcaaaagtctaagggaaggagagagacaagaatgaaacacttaaaaaggaaggaaggcagggtgctgggggagtggccatggtggcctctgccagagctggggaacgccaccaagttggaaagaggcagccacagaggagatcagaacaggcggcccagataaggtggaggagacagccaggacatccttctgaaatgggtccccatcccttccctgggagcagtctccctcacagcatctccacaccctcctgccacccttctagacttacaaaaagggtcagcagaatgatgttccatgggaaacggcgtctgaagggaaagagaagccttgattaaatgacttggggcccctcaggcgtcagaggctcctacagcagaaggaagcgcttggctcctgtgcctggaggattaagccttgactccaaggagggaggttggcatggcctttggcacctgttcaggtgtggtacgcagggacaacatgggccaatgagacagacctgtgttgtggcgccagaaacacctggattggtttgcaactcttaaactgactgcctgtgtgatggggagaaagttactcagcctctttgagcctcgggttcttcctatttgttaactggctaaaatgctacctgtcttgcagggttactataagagtgacagctagttagctcctaaacacacatggtcctttgtatacacctgaacagtagctgtcatcgtcatcctcctcctcatttcttgtaagtttccattcagctgctataaaggaatccttctttccaaaatactcggcccccatcccaatccctgtcacccctctcactgtgttaagtctctgggactcacctgggtccctggcagcaggcaaggatcaggtaggtgacaacgaagacagcactagggacaaagagatggggaagcagttcaggcccaaatctgccccgcttggcagcacacaccaggccagtgatttggggcccaaatagccgtttggaagtctgaggggaagcaactcaacaggaagcaagaacgagattacccccagccagggtcactgagatgctctgaagcaccaggctccggccaggaaggaggtctggggaggctgcagctgacgggctgagaggacatgggggctgcagcgcagcgtgcacgccaccaccagcaggtcccactcttgctctcgagttctaggggtctgctactcatctgggcacgcacacccacaccctctggcacgggaaactggcaccaacttgggggccctctcaaaaagcattttgatcctgccctgagcaaagctggtcacctagaaacagaagctgccacccctgcctccctgcccaaccacagaggagcacacactcactaggacacgtagtagacagccacatttctcctcacaaaggcgctgacaggttccctgtggggcacaggaggacaggagtagtcaccctgaggcttgtctgccccacccaggccagccaggcagccctggcttcaccttctctaattgcccatggtcaccctgagagcagggcccaccgccacccacacccccagcaggtgaccctgaacccccagggcagtaggagtgggtggcaaagcctagagacttacacaaaggtgaagatagcaatgatggccacagtgatgagcagctgcacggagatgatggagtaaacctggacacagacggccgggcatgggtcaccatccggcacccctggcctgccccaggaagctgccagcccccagtactttcctcccactcaagaaccctccctagctgcagcctggcccagaggcgaccccagtgagatgcctggctcagaggcaatgtgcacttcttcctcagccccgctcccatgctccctgccatctcccctcctgtccaacaccagcctcggtgactactgacttgccctgcctggccaccatactctaccagtatggcctctgcactcccagcagctcagtctgcacgctctatgcagctgtgagatggagagggtgggttacaagcgagtaggatcatttctggctccaagctgcctatagtctaaagggagaaagatgtctggggaaggcgggcgctgtggcagaacccacctaggagattctcccagactgaatgtgtcctcccaaaacatggtcaagaagagaggtgcaaaaagagagggaaccctggggttagagaagccaggtgcccctctgagaagcagacaaggctagagaagacaggcagccagtgtatttcatggaattgatgccctggggctactgtggcctacccacttcccattcccacagcctgaggggccccaggtacacccacctcccagcgcgtatcttacctttcggataaaagtgtgtcgcactttccggtcatcccactctccaggcccgaagctatcactcactgctctctcctccccatcatagccatggcctgggcctagggacagatgacacttgactcagctggggacctgagacatgtggcgtcaatcccaaagcctccctgacaatctcaaagtctcagggatctccagccaaaagacaagtgttataacaggaactcttctcccaagctggggtcttctagacaccctcagagtgacccagagccggcctgtcacgagggggcttaggtgggaaacgttcctcacgtgcatctgtggagggctcctgtgtgcccagcccacgccactgggggttcactggggggtcacgatgtagtggggaagccaggcaggagcaggtatgggcatccactggggcagccagccagggcagaacaggggatggggacagagggtaggagaaaaggagggcggcagagcgcagtttgtgcagcagcagggatagaggtgaagacagggatctgcatcagcctcacagaggcaggtgtgcaaagggtgtgcgtgactgtgcaggacccatgcgcagatccgcaccagcgcacatgtccaggtgagagctggctgacacccctctggggttcagagatgctgcagggctgcaaacattccctgaatgcctgaatgcctgaatgcctctttgggaactacttttaaaatccacgcttgagccacccaggaagactcactgcactctaacttcacctcatttcctttttttttttttttttttttttgagatggagtttcggtcttgttgcccaagctggagtgcaaaggcgtgatctcggctcaccgcaacctccacctcccgggttcaagcaattctcctgccttagcctcctgagtagctgggattacagacgcatgccaccacgcccggctcattttttgtatttttggtagagacagggtttcaccatgttggccaggctggtctcaaactcgtgatccgcccatctcagcctcccaaagtgttgagattacaggcatgagccaccgtacccggcctctttttttgttttgttttgttttttgttttttttttggttttttttttgagacagagtcttgctctgttgctcaggctgaagtgcagtagtgcgatcctggctcactgcaacctccacctcctgggattgcaagcgattctcctgcctcagcctcctgagtagctgggattacaggtgcacgccaccacacccggctaagtttttgtatttttagtggagatggggttttgccatgttggccaggctggtctcgaattcctgacctcaggtgatctgctcgcctcagcctcccagagtgctgggattacaggcgtgagccaccgcggccggcctcacctcatttctgaccaaacacaagcatgtccctgccatgatgtttaccaaacttggctccaaatgtcttttgcaaaagtcagatttcactttaaaggatgaggaaagtggttcaggttcccaaaggagttcctaaggaagtcgacaggtctgggaggtggcagcagcttgttggccgcttgttgggaaacagagctggtgccctgaggtaacccctcaggagtcattacttggcccagccccattctcctgtggtgtgtacgttctgggacatgcctcatggatctccttgaacaaagggggcagcaagtggctgggggccagttgctgaggcaaaaagtggagggtaacaaagacagaaacagagggagagatctcaacagagaagatgagaaagggatttaagggaaactagaagagaaaaggggcaggaggcggtggcctcatctgctccaagtgctgtccctcccacccaccttccatctgcccttccaggactcaccgtagttcatgggcatcgggtgggtggggggcatgggctgtgggtagccagcagggtgaccgtagccaggctgcgggtagccagggtaggcaggataccctcctggcaggacagatggctgcccatagcccccagggggcggagggcctgggtacagggggttgcggtcttcatatggtggtggggcgctggggttggacatggctgctcacgggctgagggggaaccccagctgctgggacctgaaatgggagaggagaaaagcaatcgtgaatgcccaggcccagctcactcagcctcatgggcccacttccagccttgtccaggctgcctccgtggagaggaacaccacctattttctccttagagggcagcgtgtgatttgctgtccacaggccacctccccaccaactgggctcctgtccctcctgcctttgcgcctgcttcttgtccacaggcctctcactgtgcagctccccagccataggaaagcaggaggaaggattcgctgaggagagagggaaccagggagcctgggaactccctgttgtggtttaagaaaaccttccagttttggtggcttgatggcagaaccagcgaagaagccagatgggccaggcacagcctcctggcgactcacagggccagctgggaccctctgaaagggtcagctctgcccctgccacagctgacggggatgccaggcctggaagccagagctgggttggagccaaggctcaaagtggagagccgggggaagaagtggaggaaaacaagctagccccagtgccagagctgccaggccccgaggaggaagggatccagggacccgggggccagtggcaggctgagtcaggaagcctgagaagcaggagtgggtggtacaggggctgggggcagggaggctgtgccaaagggccagcttgagacaggactttctggttccttcaaataacagcggtggcgtgtcagaaaggcatgcggcagcctgcgaccacagctgctctctggccttgctagggaagagagagtgagtgcacggcccctcgccctcccccttacccccaccctggagggggagacagatgttctgaatcccaggctctctgtgagttctacctgtcttccaggtgcagtgctagcagggaggacaaagagctgaggagtcaggccacaaggtcaagggaatgccttccctgcagcaggaagagccccatagccaggggagggccaagaaaccagggggagggaaccccaaactggagttggaagggacctcagggccataagccccaaatgctcacttcagatgagagaatgcaggccctgaacagggaagtgattccccagaaccccagaactcgcaggtcagtggcataaccaggacggaggccttccagatcctgggtccaggtccttcatgttatgcggtgctcttatgcctcctctgccagttactgtcctctgggcctggtggtcccctctgaggtagcagagatgcaggcttaggaggagctaaggaagcccctagagggcccctgcatccccagtaaggacaagccctggcagtctgggctcgacagggccaccacctcttctagagcatctacagggggctttaggatccccaaggaggacacccccagatgcaggtcagcagacaccagaggctctcagaggctctgctggaagcaagagagaccagcgtctctttttagggcacattgcatagttcggggatcaaataaaggactgtcttatctcttctcttttatgacaactgggataattcagagaggggaaggtggcagggagggttgaggagggggaattgaataaaagtccaggtctctaagtgggttattttgaggaaagctgttcttcatctccctagaggggctgggatagaaccagggcaagaatgtcaggtcagaaatacaaagctggcagggtgcggtaactcacgcctgtaatcccagcactttagaagactgaagtgggcagatcatgaggtcaggagttcgagaccagcctggccaacatagtgaaaacctgctctactaaaaatgcaaaaattagccaggcatggtggcatgtacctgtagtcccagttactcaggaggccgaggcaggagaatcacttgaacctgggaggcagaggttgtggtgagctgagatcgcgccaccgtactccagcctgggcaacagagtgagactccatctcaaaagaaaaaaaaaaaaaagcactggccggaaaggctctgtgggcagaaaccccaaccgtgatgtcaccatgacgtgtcccagcacctcctcagggtgcacctctgtgaaataaggtgggggcgacacgacctctaagcccactgccccctctaacaacagactatgattctgggaactcggctctgcagggcctgacctttgctcggccagagagctgcccctgctccctcctctgagccaagcagggcaaacagctaactttccagaccaagggactgtggcagccaccgggtgaaaggtgcctcagagagaagggtcagcctcggatgggccacggggactccaaggttctggtgcagctcagcgggtgctgactcagagcttcactcctgcctctcttgcccctccctttcaggcttttggtttcagaagcatgtgctagtaggcctgcctgcactgcacacagcagtttccaggccagtccttcgggtacctcagccaccagcccatccacaccagaaactaccatgaccatttcaactcactatgcctcagtttcttcacctggaaaatgggtctcacactagtaatagtaccctccacggggttgctataaaaattaagtgagaaaatacacatagaaggctgggcacagtggctcacgcctgtaatctcaacactttgagaggccgaggcaggtggatcacctgagatcaggagttcgagaccagcctggccaaatggtgaaaccccgtctctactaaaaatataaaaattagctgggcatggcagcaggcgcctagaatcccagttactcgggaggctgaggcaggagaatcgattcaacctgggaggcggagattccagtgagccacaatcgtgccactgcactccagcctgggtgacagagtgagactttgtctcgaagaaaataaaaaagaaaatacacataaagtgcttagaatgaaacccgacccctgatcaatggggataaaggttggttattttcattaaatccttacaacagtccagcaagttaatactgttattattattcccatttacaaatgaagagattgaggcacagaagaattaaatcacttggccaagataacctagctagagtgtgatgaagtcaaaatgagccccaagactgactcccaagcccctgctcttaatccctaacctgaaaacaccctgtctatccaaccttctcatcacttctgccatagcttccatctaaaaccctctcatgggttttagcctcaacaggaggctgacacaagtggaagccaaactactcaggccctccacaccaccacagggctcacagcctggccaacggccccaggagaagagggtggcccaggcttggagatacataaaggtcagagctggaaagaaactcacccaaggacagccaacccctcactttaccaactagacagccacagcacaggaacctgtccttggttaccgagctggtcctggggacaggacgagatcctagctgtctacatagagagacctgggcacaggagaggaaaccccagcattaacgctagccaggggagttgctaaactcagccacactcacctctgagcagtgccaagaacactgtcagactggcaagagcctccggggaccagggctgccgggtttggcagctttagagcctgctcttgggcttctgcccagcctccatgagggccctggccacttccacatcagcaaggcctccactagggatgaggtttggggctggcatctgcctaggtagcagcaaagggggaaagggtcagtgtttactttcgtagctatgtctaagggtggaggctagagaagaatggagggtaagggaaggagggagaaggggagagagatcacgagactgacacagagtgaggactagaaatcagatctgggttctgccagcagctactagaggggctcacagtctgcagggactttaaggtccccactggaagcctgaattttcccaaaatacagtaggcattcaccttctgcttgtttttgtttttctttttgttttggtagaaacggggtttcaccatgttggccaggctggcaaactcctggcctcaagtgatccacccaccgaggcctcccaaagtgctgggattacaggcatgagccactgtgtctggcccaccttctgcttgaaggaactccagcaacatggagcaagccccttgtctgcagacagctcgattagaacattcttccttgcctcacaatgcctgttatcaaggcattcagactgtgccctatccttgcccattatagatctaagtttgctcctctctcagggccccagtcccccattaggaaggaaccagagcccctgctttctaccacagcagcggcacaagtgggtgagctcagacagcaggacttgctgggtgtcaaggttttcagatgcagaggcggaagcacctcctcccctggagccctctcagtgtggtaatcctgctgtctgcctactgaggccccggctggggctctcctgggggtatttgaagggttaaggctccggaatctgcagaggaggcctgagctactggggttacagcaagaggagagtatgtgtactggagggagggatggaaaggagcagctgactggtccaggcagcctgccctcctccctgccagagacggatgcccagagtggaaaaaaatagctcagaatgcacatctcaggaaaccccacccagcaggcgcaggagcacagcccagatctgacgatttgttcccctcccttttcctttatctgcccccacaagaaaacactttatcctcctaccccagggcacagctgacctcatagccacgagagcaaatgagtaaaaagatacacccaggagtgtctgggcaagtcaccaggcctgattctgcaccaagggggcccagaatcaactaaatatccttccatcagcctggactttgggactaagaggatgaagccacagggatctaaacactaaaatatcagagctggcttagactttggatctcacctggtcatttgacagacaaggaaaccccagagccaagaaagttcctgctccaccccagaacagccctcttcttcgtcatgggtttggaacttcccttcccagccccgcccactctctgagtgatagacaccagcacacaccctctcccaaggaggggccagaacaagctaccattctctcagttctctagtgacctctcagctcagaaacagttaagaccgggccgggtgcagtggctcatgcctgtaatcccagcactttgggaggccgaggcaggtggatcacgaggtcaggagatcaagaccatcgtggccaacatggtcaaaccccatgtctactaaaaaatacaaaaaattagctgggcgtgatatcccacacctgaagtcccagctactcgggaggctgaggcagggggatcgctcgaacccgagaggcagaggttgcagtgagccaagaacatgccattgcactccagcctgggcaacaagagtgaaaccccatctcaaaaaaaaagacagccagccctcgacttctggcccccaactcgaggccacccctcccagccccctctctagccagggtggcctctctctggacccatggagaccgaggggtggctccaagctcccaggagggagaggctgtcctggggatcacgagaggacccaggcaccgcagctccgccacccttgtctggagcagaatcctgtgatcagaatggtaatctcgggttaccccacccaagtcaggatggcctgggagtacagataagggaagaggaagccattagcaggctgatgctataatacttctgagcacagtccctgttcacttccttctttgtttcatctcctgtcttttcattgaacttcaagattaggaggggaaagagacagacaaaggagactgataactaaccccaaaaaagaactagggaaggggccaggcatggcggctcacgcctgtaatcccagcactttgggaggccaaggcgggcggatcacgaggtcaggagatcgagaccatcctggctaacatggtgaaaccccatctctactaaaaaatacaaaaaattagctggatgtggtggcggacgcctgtagtcccagctactcgggaggctgaggcagaagaatggcatgaacccgggaggcggagcttgcagtgagtcaaaatggcgccactgcactccagcctgggcaacagagggagactctgtctcaaaaaataaataaataaaataactagggaaggaagggaaccacttagagtagttgaaccacttccagtacttactatataactaaggaagtacaggttgaatatccctcatttccaaaatccaaaatgctccacaatctaaaacattttgagcaccaagatgacactcaaaggaatgctcactggagcatttctgatttcggattttcagattagggacgctcaaccagtaagtataatatacatagccccaaatccgaaaaaatccaaaatccatgtgcttctgccactgtagatgtctgcccccatggctatcgtgactatatgctcgagtaggagagtaaagtgttttcttgggggtggaagggagttggggtgggtaaaagaaaagggagggaaggaaattgtcaaaatggtcccattttggataagagacactcaacctatagtaactaaggcacatctgatccttgcaacagtgctgtgaggtattcttaccctcatcccactctatagatgagataactgaaattcagaaaaaaagagatctagggtcccacagcaggcaaacagcagagatgagtttaagcatagatctcacacctgatttaaaattcagcctctttgcttttatatcaggcaggagtagaagcccctgaggcatctgtagcacgcacctgcgtgaataggcagcaccagggtggggccaaggcagtaaagatcaaaacgatagatagaaaggagctgagcaagctgttgttgctaccattatttctttcccctgcggaaagttgatctgaagcctgggtcctgggctaggaggtggggacctgaagttcttgtcctggctttgggactcactccactgtgagagccacatctctagacccagttttaacatcagtaagacaattcccctcaaatgaaagaatggccaggcgcggtggctcatgcctgtaatcccagcactttgggaggccgagccaggcggatcacttgaggtcaggtgttcgagaccagcctggccaacatggtgaaacctcgtctctactaaaaatacaaaaattagccgggcatggtggcacatgcctataatcccagcttctcgggaggctgaggcaggagaatcacttgaacccaggagatgtaggttgcagtgagccgagaccatgccactgcactccagcctgggcgacagaaaaaaaaaaaaaaaaaaaaactgaaagatcaaagtccactctgccagtttctgattctgaatgaacagcctaacaggaggcttcagggcagaatggcatggctccccaagaacctacaccagggggtcactactgatgtgcaactgtttccaaggacatcttcagaggcagaagtacatggcatgttctcagtatggggctgtccacaccctcccaaactgtccccataatgctgtctggaccctacggccagctcttcctgggtgatcagttacgcccgagctaaacagtatataacactctaggaaagaaagagtaggaggcaggaagtccactgacctgggttcatgaactagctgcaggaatccaggcaaatgacctcccctggcctccttttatccctaaatcagcccacgtgggggaaaggagtagggacttgtttatgggagccacagtggagaaacagaatcacctagccaggcatttcccagactgttctaaagaacacgccccaggagacgttaatgaatgagtgctggaaacagatgactcttgagaaacaatccacacccccttcttggaaattcacaatggcatattctgcccctgagaagtcctgcagtaagcaaccctgttcagctttgtttaacccagtgttccttcaaactcccttaagcctgagccacttttatcgaggcaaacctattaacaccctgtgggatgctgacccaggccacctttgtattacagacacccaaccctgagaatcattcatatcctaactcctcgtctcttataacctctgtgcgtacacccagctgcccctcagagcagtcacatgaagtactagacatgccctctcactctcagggggtcagcccagtgccaggatctctggcgagggtcctccccttcccccattccacacagctgctatcccaccgtgggatttactgccaagggccgggggacatatccagctaccacagaaccaggaaacgggcacccctaacctcacctctgtgcaacggggcaaagcacaaatcattacagacaaaagtgggagctcattaatatctcccttcccaccaatggaggtacctgccactgtagcctgtcgacttctggatatcatttctacttcaaaacaagacccaggttttggcctagaatcccagaatcttagggttggaagattctgtcaaggtcatcccttccactgtgtccccaacagaataggtccagaaggcccatgtcatgatcagacatgttgttagcagaacttcttcccagagaattgtatgagcttccactctctggtcgtcccagttcagccctctgaaaacacacaagtatgtgtgtttcccttctctgtggcttctgctttttctgaaaggcccagggtgaggcctgcggttggaggtgctctgaggtagacagcgtctggctgaggcacccattcccaggggaggaggctgagcccaggtggctattaccccagctcatgacatgaggctctcccaacacttacaggataacccatcattacctctctgaagggctcatttttacaagtgaggccttgaggtcatagcacagaaagacagggcccctgacactgtggtcctgcctcttccatttaagctataaactggttctctggatcctcatgactggagagacagagagaggaggcaggtgagaaggaagtatggctccccctttgcgccaataaagcagccccaggaggcacctggctcccctgccaccactggccagcccaaagtcgccagcttggaaaccaaagctcactaatgagatgaatatttcagagcccagagaactggacacctgagggcccttccatgacatctggctctgacctgcgttcccaggcctacttatcccatgtccagggtgctcaggtagaaccccaaactcctgggtaccacgtagaggccacagaggagggagaggagatggagaccccataggacaagaattggtgccgaccccacaaggccagggcctggcctcccagcagcctccctctgcttcctcccactggtccctggctcctgccccagtctctccacttgctttcccttttcccgtttctctgttttgttttcactctaacccaaagaagtcacgaggaggatgttactcccctgtagttctgtgaacccagccgggaaacagtggctggaagtgggactggcagagggcaaagtcatggtgatagaggtggccacttccccatgccaaacacttgagctgctcattggcttctgccccagctgcaagctaggacccccccttccccaccccttaaatattcacctgtctacaccgagactggcctcagcgcgtgtgggggcaacctggggtccgtgccaggccctggctgtctcccctccctcttccctcttctcaccagctgagggccatgaaagccctcatcccacacagctggccactcgggctggcatggtggataggccctgcgacagagaggccactcgtgcccgaaagagggaacacgaggacacccccagaccctggctccgctcaccagtgcccacaacacgctgctgggctcccaaggctaaccaggtgccacagacccggccgcccacccgcgcgcccagggagagcgaaacgccaagggccaggaggggagatccccatctggaacgggctccttgggcccaggagcgggcaagccgggagcgcgctccgaaaagtttaggcgccccggcgcatggccgccccagccctggaccagtccccaccgcccacagtccccaacggcgccggccccggccccctggcttgcctgcgccgttccagacggagcgttcctggcctcggagtgttgcaagtcctccggggccgggcagggctaggctcggctggggctccgcgccccgccccgtcgcgccggcctcgtggggcggggcctcagggcgccgccagggggcgcaggggtctgtcccgggcgcgcgcgcctctcagagccccgacgacgcctcactaataacacaggggtattttcggatttaaaggcaatacatgatactgataggaagctagaaaagacacagaaatgcagggaagaaagtaatttctctccacccctcctagttcccagggggaagcgttcgctttgggtccttctttggctattacatttctgtatgtattttgtttttctacagtggggtatattgtatggtgttttgtttactgcccttctttttactgttttatgatgaacatttttcttctcactaaatagtcttcaaaagcacaatcttaatgccgtgaagtattccattgcatggctatgcggattaaattaatttcctactggaggccgtttgtttcccatttttacattacaaataaatcagtaattaaaatccttgataattctgtgtttttgagataaatgcacttttcgagtttaaaactgcaaacatgcaaacctagaatctctgtttataattactcaaccaggaaagcaggtgctttcctcaagtcagaattcagaagtcctacattgagatgtagattactactgttaggtaggtcttaaccctcatctcagtgaagaatgcagtagcaaaggaggaaacagttttgaggaagttctgaaatattactggagcctgggcatggtgactcacacctgcgatcctagcacttttgggaggccaaggccagaggatggcttgagcccaggagttggagacccagcctaggcaacatagagagaccttgtctcaatttaaaaagagaaacattaccgagccttgcctgagtttctgtggttccaaagtccaagttctttccatgacaccaaggctgccagtagttgaccaactctgtttaaagtgcttatctcatgttaatagctataggtcagcaccacaccaccactgaatgtccttttttttttttttttttttttccagacagggtctcgctctgtcacccaggctggagtgcagtggcgccatctcggctcactgcatcctcctcctggtttcaagtgattctccggcctcagcctcctgagtagctgggattacaagtgtgtgccactacacccagctaattttgtttgtttgcttgtttgttttgtttggtttgtttgttttgtagagatgggttttcacgttgttgcataggctggtctcaaacccctgagctcaaagcagtcagcccactttggcctcccaaagtgctaggattacagacatgagccaccacgtccagccccaaaacagagatttaaaaaaaaaaaaaaaaaaaaaagacagatttttaaaaactgccccccatacacacactatgtatgtttatttctgtaaatatagtttaagtaggagttacttagggggactagtggccgttatggtgggctagctccccagacaccccaacccttcagtgtacttccagttcctacaggccaagaacctcattttaggaagtccccacccaaggtgtgatctcaccagagcaagtacagttctgctcagtgtctgtctcccccttgctcaaggagtagcgccctaggtgaaatgcatggcccatggaatctgtccagatccctgacattttttcatgctctctacacttgtgctgtcttagtccatctgggctgctacaacaaaaataccttagagtgggtaatttagaaacagcagaaatgtattgctcacagttctggagggtgggaaacgcaacatcaaggcaccagcaggttaggtgtctgatgaaggctccctctgcttcacagatatcgtctgagtcctcatatggccaaggaaggaacaaacagacaccgcccccccaccagccttccttttttttgagatggaatctcactctgtgcaatggcacaattgcagctcactgcagccttgacctcccatgtacaagcaatccttccaactcagcctcctgagtagctgggactacacacatgcaccaccacacctggctaatttttgtattttttgtagagacagggtctcactatgttgcccacgctggtcttgaactcctgggctcaagcaatttgccctcctccacctcccaaagtgctgggattataggcgtgagccactgcacctggccaccagcttcttttctaagagcatgaattccattccagagggttccgccttcatgacctaatcacttcctaaaggcctcaccttttaatactataacattgaggattaagtttcaacaaatgaatggagtggggacaacaacattcccaccatagcaggccccttctccagaaaacaccctccactttctagaaccaccaggatggttaatatccaaggagattccatttccaaccagcaatcaccagcgactcacatctgcccgactgggggagtgggacatggggcacacgaggcaagcccacacaagccttgctgcgtgctttttctccagagccctttttctgactatagggtcaaaaataacacctgaagcgcctggcccagagcagcagtgcttcgctggcaataggcattcgataaatgatgtttttttctcttgggccttatctgcaaaattattaagtaagcttttattgtctgccaaccagacaggaatttccggttctagaaatgagaaggctgaaagaacacagcccctgctctcaagaaactcacagtctaagggagccagtaaaatgacagattattacaatgttgacagtttgacaagtgctggcagataaagaaatattcacttggttcctccagatcccagagaaagctcctaacccagtgtggggaatggggtgggggttcgggaaaggagttcagaggaggtgacacctgagtagagtgttaggaggtgttaggaaccagcctattcggaggaggggagaaggttctccaggcagagggcaagggacttagggccagttgccccagcaagctaggatggggggtggagggtgcagtggggtagaaggggtaggaaatagggctggccaaggaggcagggggccagaaattgagattttaccctgaaagcaatggggagccagaaaataaccacctagagggagtttgggagggttggggaggctctggtggtgcccctggggtagggttccagctttagcaaataaagatgcaaggcaaccagtttgagcttcagataaacaacaaacctttttttttttttttttcaagacaaggtctggctctgcactcccaggctggagtacagtagtgcgatcttggctcgcggcaacctccacctcccaggctcaagccatcctcccacctcagcctctcaagtagctgggactacagacatgagcaccaccacgcccggctaatttttgtattttctgtggagacagggttttgccatgttgcccaggctggtcttgaactcatgagctcaagcaatccatccgcctcaccctcccaaagtgctgggactacaggcatgagccgctgcgcccggccaaacaatattttttcatataagcatatcccactgccccatataatatttggaaatacttgtactaaaaaaaagtactcattgcttatctgaaattcacatttaactggttggttgtatttttccagcaacactacctaggaggaaagtggagtcaagtccatggctgcaggaagaggggtggaggagtgaaagggattagactgatgtttattttaggactggatgttattttaggtattttaggactagctaaagcttagtgattggtgggagggggtggtggcagcctggaaggggtgggcccaggtggaacctgaaggacatgggcaggaaaaacttaattggagcggtggatccagagaactttctctgttgccaccctccagcccagccccaggactccactaattggtcctccaaacccttctcatagctgcctggttacctagcatttaatgtgttactctacccatgcattgatcactaactttctgaaagaagttgccttttttctgtttttctttttctttctttctttctttctttttgagatggagtctcactctgtcaccacggctggggtgcagtagcatgatctcggctccctgcaacctccgcctcctgggttcaagcgattctcctgcttggcctcctgagtagctgagattacaggcgcccaccacaatgcccagctaatttttgtatttttagtagaaacagggttttgccacgttggccaggctggtcttgaactcctggcctcaggtcatccacctgccttggcctcccaaagtgctgggattacaggcaagagctaccgcgccgcccgaagttgcttgttttcagaggacgtatttactgaattgaggcattgaacccagcctgaggtgaaagtgcctgtttctccccactggagggcagagacaatgtctcattcacccctaggcctgggcacggccctgacccagcatctgttgaattgaatgccaatgttccaaagtgggatggagggagcctctcaggcttgaatgatagatgtgtgggggatagataaggtaggggtggggtatgggggctcctcccccttaaaattggccttattattcataaacattatttaacactttcctaaggaaatagagagtggaaagaatggtggatttggatgtctcagaagtgaagttttgttccagctttggcactaaaggactgtgaggccgggggcccatctctctacttagaaatcacactgtggctggtcacagtggttcatgcctgtaatcccagcactgtgggaggtcagggggtggatcacctgaggtcaggagttagagaccggcctggctaacatatagtgaaaccccatctctactaaaaatacaaacaattagccaagtgtggtggcgcatgcctgtagtcccagctacaccggaggctgaggcaggagaatcgcttgaacctgggagacagaggttgcagtgagccgagatcatgccactgctctccagcctgggcaacagaaaaagactccgtctcaaaaaaaaaaaaaaaaaaaaaaagagagaagaaaagaaatcacagtggctcacgcttgtaatcccagcactttgagaggccgaggcgggcagatcacaaggtcaggagatcgagaccatcctggctaacatagtgaaaccccgtctctactaaaaatagaaaaattagctggacgtgatggcaggcgcctgtggtcccagctactcaggaggctgaggcaggagaatggcatgaacccgggaggcggagcttgcagtgagccgagatcacgccactgcactccagcctgggcaacagagggagactccatctcaaaaaaaaaaaaaaagagagagagaaatcatactgcatttctctacctcctgtgacttctggcgccttcctcagttgaggtcatctaggtgaaaggcagtgagaaaggcacatggcggatgttgatggtgactgaaactgctgtaactggaagtgggtggcaccatgaggaagccaggccacggaaccagcctggcatccaccatgctgcaggcagggccagcgaaatgctttccattcttccctgaccctcagagtcacctgagctgcttgtgaaaacatgcacgttcccttggggatacttctttccagacctgtgaatcagaatcttcagtggaagcataaacaaacgctccccaggtgaatcgccagccacaccagcaagctttggtgatagacagtcctgggtttgaatccaagttcaaatgtctttggtggctttgtgaccttaggcatattacttaactgctgtgagccttggcaccttatctataaaaagggtggtaataatatagggtagttgtaagaatgaaaaatagcagttgtcaaatgcttggggcagagttaaaatgttcattgttattgttgtttgtgagatagaagcccagtgattctcccagtgatgaacacaacctcctttcacactaagcagggcctggagggatgaacttgcccgagctgggagctcagcagggccaggctccagctgtgcccttacaccctgccctctcgccatggacctctgccacctctgccagccagaataccgggggattctcagctttcaagcccctctcctcgtccatcttgggcttcattctcccactctcttgccccccacctaggaagctcctcctcatagatacttgcttttgtctaaacaactctactccccaagaaaagccaacagcgatttcctcttattcccaacccacgatattagctgcctgagaacctctccttaccaataactgcaccccctccataatctcaatttcaggcaccccacactctgaccaccatctatttttccagctctgtgaccgtgatttgacaattctgtgaccatatcaggatcaacaatctattcatcttaccacctgttcctttattttatttatttattttattttattttatttatttattttgagactgagtttcgcttttgtcacccagcctagagtgcaatggcagtgcaatggcgcgatcttggctcactgcaacctccgcgtccgaggtttaaacgattctcctgcctcagtctcctgagtagctaggattacaggcacccgccaccaggcccagctaatttttgtatttttagtagagatgaggtttcaccacgttggccaggctggtctcgaactcctgacctcaggtgatccacctgcctcagcctcccagagtgctgggattacaggcgtgagccaccgcacccgacctatttgtttattcatttatttttgagacagggtttcgctctcacccaggctggagtgcagcgaagcagtcatggctctctgcagcctcagccccctgggctcaagccatcctcccacctcagcctcccaagtagctgggaccacaggcacacaccactgcacctggctaatttttgtaatttttttttttttttgagacagagttttgctcttgttgcccagtctggagtgcaatggtgccatgatctcagctcactacaacctccacctcccagtttcaagtgattctcctgcctcagcctcccaagtagctgggattacaggcacgtaccaccacgccaggctaattttgtatttttagtagagatggggtttctccatgttggtcaggctggtctcgaactcctgacctcaggtgatccgcccgcctcagcctcccaaagtgctgggattacaggcgtgagccaccgcgcccggctaatttttgtaattttttgtaaagatggggtctccatatgttgcctaggctggtctcaaactcctgggctcaagtgatccacctgcctcagcctcccaatgtgctgggattactggagtgagccaccgcgcctgaccaccacctctttcttatctctcacatcctcactttcctccttgaccagcttggattccaatattataattactcctttgcatgcagcctcaactctaccttatggttctcagcagcaaaatctcaactctgcacccacatagccaaaagtgagggtaaaaacatgcaacggtcctgactgatctcgctttaagttcatgcacactaacttgtccattcatactaacacacccatcctaggcaattactccacactttctacagtcccttctgaactcccacacctcctctgcagcctcactctcagcctcgactttgcttcctatgtctctgagcaagcaatcagagaattgctgcctatatcaccacttggatgtctaataggtgactgcttctcaaactttaatgtgcaaatagatcgcttggggttcatgttaaaatgcagattctgcttcagtaggttgagagtctacatttttttcttttcttttcttttcttttttttttttgagatggagtctcgctctgttgcccaggctggagtgcagtggtgcgatctcagctcactgcaacctccgtctcctgggttcaagagattctcctgcctcagcctcccaggtagctgggattacaggcatgccccaccacgcccagccaattttgtatttttagtagagatgtgttttcaccatgttggtcaggctggtctcgaactcctgacctcaagtgatccacccacctctgcctcccaaagtgctgggattacaggcatgcaccaccacgcctggccataggtgaatttttaatgggatttttaaatactaagtcttcaaaatctggtatgtatttgacacagcatatctcaattaggatgttactttttcatcagaaatataggatctgtatttagatcaaatctgaaaagtgtttgtaaaatgtacatacttgagtgttttccaataactgaaataagcatcaaggtttattttattattgttttatttttagagtaaaatgaaagcaagtttattaagaaagtagaggaataaagaatggctactccatagacagagcagccaatgtttagatttaagtttaaatgaattaaaattacataaaattaaaaattcagttttatagttgcactaaccacattttatgtgctcagtggcaagtggctagtggctaccatatgaaacagcacagatctatagcgctggtcattgacttaagggggaattctgggggtcagggtctagatcgtaattcatcttggccagatgcctagcccagggcctgcactcagtactttctgctgcgttccatttacttttaacaagtcaaaaactgacatctaggaagcggttggaacaagccacaatcagttcccagacatgaccactagggggcagagtctgactagcactgtttggctagaaaaagggagccttggccgacgcaatggctcacacctgtaattctgcattttagccaggcccaggcagaagcatggcttgagcccaggagttcgaaaccagcctgtgcaacatagtgagacccatctctttaaaaaaattaaaacattagctgggcatggttgtgcgtgcctgtagtcccagctacttggaaggatgaggtgggaggttggcttgaccccaggagggtcagggctgcagtgagctgtgattatgccactccagcctgggcaacagcctgagctaccatctgtctcaaacaaacaaacaaaaacgggagaaaagaaaggggccaggactcaaccccaataccattaagatttatttaacaagcatttatgaggggccaactgtgtgccagacctgtggggatacagaagtaaataaaatacagcccccgctttcttggagtttacagtccagtagggaaggcaggacagatattagcaactcatctcataagcaaaggtatctttacaaactgtaatacatgcacttaaggaaagctgactcagtgccctaaaagagtggcacccaaggcagggagctgtggctcacgcctgtaatcccagcactttgggaggccgaggcaggcagatcaccaggtcaggagatcgagaccatcctggctaacacggtgaaacctgtctctactaaaaatacaaaaaattagccaggcatggtggtgcgcacatgtagtcccagctactcgggaggctgaggcaggagaatcacttgaacccaggaggcagaggttgcagtgagctgagatagcgccactgcactccagcctgagcaacagagtgagactgcatctcaaaaaacaaaaacaaaagagtggcacccaggcacctcttatgttggcagaaggtggcatgaaagagtagctacagaggggatgggccgtggggggtggtggacaatggtgctgtgacccttctaagcagaaggatcaagctatgtgaaggtgtggagacacccctgaagctgaaagagcttggcatgttccagaaacttccaggagagtggtgtggctggagagtggtgggcactggggcatggcccaagaggagactggggaggtggcaggggccaggtctacagagtctcagggcctctttaaggacttcaaatttcagcctaaagatatcaatgaaaacattcaaactctgtaaaatatttgaagaaatttattctgaaccaaatatgagcgactatggcccttgacacagccctcaggagaccctgagaacacgtggcccaaggtagtcagggcggggggacaggggcgcagaatgtatgtgtgtgttgaagggagcttccaggttataggtagatttaaaaattttctgattggcaattgattaaaagagttacctaaaggcctggaggttttttttctgtttgttcgtttgtttgtttgtttgttttatggagtctcactctgttccccaggctggagtgcagttgtgccatcttagctcactgcaacttctgcctgccaggttcaagtgattcttctgcctcagcctcccaagtagctgggattacaggtgcccaccaccatgcccagctaatttgtttgtatttttagtagagacaggttttcaccatgttggccaggatggtcttgaactcctggcctcagtgatctgcccaccttggcctcccaaaagtgtaatccttgggattacaggtgtgagccaccagcccagccctgaaccagtctttcaggttaactttggaatgccctggcagaggagggagtccattcagatggctgaggtgagggggcattgaattttatttttggtttacaaaggaagccattgagtgattttgagcagggctgggacatgggacatgatctgggtggtattttaggagaatcaccctggctctgagcggtgaatgggttgagggaatggagcccgagagcaggaaggccttgaggagccaccttggctacaagatgaaaggtggtggcaccagcccccaccctgaggtgtcaataccccacgacccccatcccagacctgcacttctttttttttttttttttttttgagcagagtcttgctctgttgcccaggctggaatgcagtggcatgatctcggctcactgcaacctctgcctcctgggttcaagcgattctctgcctcagcctcctgagtagctgggattacaggtgcccaccaccatgcccagctaatttttgtatttttagtagagatggggtttcaccatcttggccaggctagtcttgaactcctgacctcatgatccacctgcctcagcctcccaaagtgctgggattacaggtgtgagccaccacgcccggccagacccgcacttctttggtttcatttggctggtttccgtttgctctccacatccccctccgtcttctccaccctgcttggagctggtcctatggacacctcagtgggctcttggtcctccagctgcagctgagtttggcagtggagctctccaggaggagatggcagcagaggtggagggtttgtctccttctccctccctcaaggctcaccccagactggcttatccctcaaccagtggtcacagcccctatcagttgggcctgtccacacagctctgtctttgttttttgtttttgagacagagtttcgctcttgttgcccaggctggagtgcagtggcgtggtctcagctcactgcaacctcccagttcaagcgattctcctgcctcagcctcccaagtagctgggattacagatgcctgccaccatgcctgattttttgtatttttagtagagacagggtttcaccatgttgaccaggctggtctggaactcctaacctcaggtcatccacccgcctcggcctcccaaagtgctgggattacaggcatgagccaccgcacccaacctgtctttatgttttataacagctcccttcctgacccttcaggcccaggggtggcgacagtgtcactagcctggagaactgtttccagcacctgccggtagccttgcagagcactaaaacttaacttctctcaagctctcctcagctttcccagtttgcctgtgtcatctgtttcccagcagacactgacacatgttttctacccaggctggttacagaggatcagtggaaagagcatggaattgggggtcaaataaaaccataattgaatttgggttttgtcgcctgtgatggtatgagtcattattctctccaagccttcgtttgttcatctctaaagtggggcgactggccgggcacagtggctcatgcctgtaatcccagcactttgggaggctgaggtgggtggatcacttgaggtcaggagttcgagaccagcctggccaacatggtgaaaccccatcttggtgaaacacaaaaattagccaggcgtggtggcgggcacctgtagtcccagctactcgggaggctaaggcaggagaatcacttgaacctgggaggtagaggttgcagtgagctgagatcgcgccactgcactccagcctgggtgacagagcaagactccatctcaaaaataaataaataaataaagtggggcgaccatcaccttccttatagagtcgtgacaatgaaatcccacgtgcaagggctgtgcgcaggccttgtgctcagtagacagtctacactcggttgttctgttcttccttcccacacaacagaacaaacatttatcacactgcatgcatcaagcccagtgcaaggtgctggggatgagggagagacaaacaagtggaggccgccattttttgcctacagggagagctcagtcttgtttttgcctgttagtttgtatgtttgtttgtttctgagacagggtcttactctgtcactcaggctggagtgcagtggcaaaatcatagttcactgcagcatcaacctctgacctcaagcaatcgtcttgcctcagccactcaagtaactgggaccacaggtgcatgccatgtctggctatttttttttttaattttttgtagaggtggggtctcactgtgttgcccaggctggtcttgaatttctagacaattttccgatccatcatcccgccttggccttccaaagtgctgggattacatgcatgagccaccacccccagcccagaggtcagagtcttgtaaagaaaaggctatggctcctctgggtgtgcccccttccgcccccaccatagccaaaccattcgtttctgtttggctgtgagatgacattttttccagggtctggagttagagtagtgaccaggcagtgcaaataattgtggtaatcagaaaagccttcgaagaggaggttgaatttatttttagccttaaagaaactggactaaaaggaaaggcattatcagcctccttgagaactgaactcattctcctccctcctctgttgagagctgccagactccctagattgagaattggaccttcattagttatggttactcctggaagggtatcacatccccgggggcatggtagggctggaaggtacctggtatcttgaggaagctgcctaaaaggatttctccaggtggcatggggcagaaatctaggatagtgatcagggcaggctggcagacgggacacatgtggaggggagcagcaggaacgccacacactagagaactgggctgagaccatgtcgctaaaacaagggatgcaaatttgattgtgtagacactggctttgagcagggggagcccctgcttgaaactgatggctaggggctgcaggtgcctgcaatgggccaggcatgaggacccaagggcctgatttgggatgatgcaatgggaaatggaggcaaaggtcacaccctcttatcatttcagtcataaaatatttacttgagcacccaccaggacagatgctgatgttgcaagaatgagatcaataatatcaaggaacatgtgtggagtacttgaaacggcccaggcaaggtgtcctttctctgggtaatcacggttaatcctccgagtagctccatgcaaattaccagtccctcgtggagagaaagagaatgaggtttgagtagattaagaacattgccccaaggtgcagagttcctagtggagccagggttctaagctggtcattccaagtctagcacacaacccccaaacccgattccactccctccccgacagttcaccctccttacccacaaggcacttgaagtgttatggggcagcgccaggaattactgcacagcctaaggaccatcacagagacatgtgtgcaatgaagtgtgcaagtcattacctaggcctaagagatgccctcacccaggagctaggtgtcgggattggtttgtttggtcatctgacaaacacagatgcttcctaacttatagagtggttacatcccaataaactcatcctaaattgaaaatatcctaagtggaaaatgcattaaatacacctaaacctaccaaacatcatagcctagcctagcctgccttaaacatgcacaaaacaatgacattcgtttacagttgggcaaaatcatctggaaacacagatgatgccgttggccaagttggcagacctgaaggagagggttggggtcacatgaggatgaggaggtagctttggacaaatcaagttaaagatcccgtgtggcagcagtccccagcatttttggcaccagggaccagtttcatggaaggcagtttttccagggactgggggaggcaatggggttaggggggttcgggatgattcaagcgcattacatttattgtgcactagatttctattattattacattgtaatatataataaaataatcatacaactcaccataaggtacaatcaatgggaaccctgagcttgttttccagcagctggatggtcccatctgggattgatgggagacagtgacagatcatcaggcattagattctcataaggagcatgtaacctacatccctcacatgcgcagttcacaatagggtgcgagctcctatgagaatctaatgctgctgctgatctgacaggaggtggagctcagagggtaatgcaagcaatgtggagcagctgtaaatacaggtaaagctttgcctgtcctgctgtgtggcctggctcctaacagaccaaggaccagtatagggttggagggaagcggttggggacccctaccgtggggcatccaagggaggctcttgtggacatttctcctttgaagtaatgagtatacaggtggtagcctgtaagtggtgaatttagagctagcagaaggggagcttgtcagagaggggagaggagagccagagagactgtggcagggaaggcagaggaaaaaggcatgctccattgtcatagctgccacccagaggttcagtgataagggctgaacaatgacaaatgggtttgaccttcaaggggacagcgccaaattaggatggagcagtacaggcaggggcccagttgagtggcctgagaatggacgtgaagtgaaaggtagagacagcagagaggactactttctttgttttaataaaataataattttaaaaattaaaatactaatatgttttcattatagaagatcagaaaatattttaaaagcacaaaaaaataataaacaaatggtaccccatgagtcaatcaaccaaagattatgactggaagcattttagattttttttttttttttttgagacagagtctcactgcacatcactcagatgtgcagtggtgccatctcggctcactgtaacctctgcctctcagattcaagtggttttcctgcctcagcctcctgagtagctgggatgattcaggcacccgccactacacccaactaatttttgtatttttagtagagacggggtttcaccatattggccaggctgttctcaaactcctaagcttgtgatctgcccgcctcagcctcccaaagtgctgggattacaggcacgagccaccgtgcccagccttagattttttttaatccatttttgtttacagaggtacaatcgtatcagttattcaaaatttacccagttttgtgtcctatttttttctccactactttctttctttcttttttttttttagacgagtattgctctatcacccaggctggagtgcaatagcataatctcggctcaccgcaacctccacctcccgggttcaagcgattctcctgcctcagccacctgagtagctgggattacaggagctgccaccacccctcagctaatttttgtatttttagtagacagggtttcaccatgttggccaggctggtctcaaactcctgacctgaggggatctgcctgcctcaacctcccaaagtgctgggattacaggagtgagccaccgtgcccagcctcctccacttctttccttcctttctctttttctctctttctctctctctttctctctttctccttccttccttccttcctctttctgagacagagtacagtggcgcagtcatgtctcactgcaatcttgacctccaggatcaagagatcattcaagatcagcctgggcaacatagtgagaccctgtctctatttaaataaaaataaaataaaataagagatcctcccaccacggcctcccaagtagctgggactacaggcacccactaccacgttcagctaattgtcatatttttcgtagaaatggggtttcacagccgggtgtggtggccaagaccagcctggccaacatgatgaaacctgtttttattaaaaatacaaaaaaattagccgggcgtggtggtgcatgcctgtagtcccagctactagagaggctgaggcaggagaattgcttgaacccaggagccagaggttgcagtgagccaagattgtgtcactgcactccagcctgggcaacagagagactccgcctcaaaaaaaaaaaaaaaaaaaaaaggaaagaaaaggagaaagaaaaaagaaatggggttttgctatgttggccaggttggtctggaactcctgacctcaagtgatctgcccccttggcctcccagagttacaggcatggccaccacacccagcctccagtttatgggaaaatataaaatttacccaaagtactagtttggatgctcttggctgcaggtgtcagaaaacccaactgaggccaggcacagtggctcagcctctaatcccagcactttgggaggccgaggtgggaggatcatttgacgtcaggagtttgagatcagcctggccaacatggtgagaccccatctctactaaaaatacaaaaaaaattagccgagcgtggtggtgcacacctgtaatcccagctactcaggaggctgggggaggagaatcgcttgaacctgggaggcggaggctgcggtgagccgagatcgcgacattgcactccagcctggcgacagagcgagattacgtctaaaaaaaaaaaaaagaaaagaaaacccaactgaaagtggcttacattataagcaacaagaagcccagagcagcgtgtaattccaggattggttaattcaggcagtcggtgaggtctccatcacttctgctctgccatcctcgggtgctggcatttcctcctaaacaaactgctccccaacagtccaagatggcgtctgtggttccagcatcccaggcaggtgatggcatcttgaagcaagaaaatagccctgttacagtcaagtgccacatgacaatgttttttgtttttgttttgttttgtttttttgagacggaatctcactctgtcacccaagctggagtgcagtggtgcaatcatggctcactgcaacctccgcctcccggattcaagcaattctcctgcctcagcctcccaagtagctgggattacaggcacccgccaccatgcctggctaattttttttatttttagtagagatggggtttcaccatattggccaggctggtctcgaactcctgaccttgttatccccccacctcgacctctcaaagtgctgggattataggcgtgagccactgcgcccggcctacataacaatgttttaatagcgaaggaccacatgtataacaatggtcccatgagattattgctttattgctttttttttttttttttgaggtggagtctccccctgtcacccgggctggagtacagtggcgccatctcggctcactgcaacctccgcctcccaggttcaagcgattctcctgcctcagcctcctaagtacctggggttacaggtgcgtgccaccacacctgcctaatttttatatttttagtagagatggggtttcaccatgttggtcaggctggtctccaattcctgacctcaggtgatctgcccgcctcggcttccaaaagtgctgggattacaggcgtgagctaccatgcgccccatgttacagcaccttttctaggtttagatacacaatatttgctattgtgttgtaattgcctacagcattcagtacagtaacatgccgtgcaggtttgtggcctaggagaaataggctataccaatcaacctaggtttgtgtaagtacacactatgatgtttgcacaactacaaaatcacctgacacatctctcagaatgtattcctgtccttaagtaacacatgattgtacatccctttttaagaacaagcagaaccttcctagaaggccttcagcctatttgcctccccatctaatcagctgtgtgacctggagccattgatctgatctcagtacctcagggttcctatctgtgtaattgaagggggccagcccctacgcacctgtggatatttctcatcaggtgggacgagagactgagaaagaaataagacacagagacaaagtatagagaaagaactgtgggtccaagggaccggcgctcagcatacagaggacccgcaccggtgccggcctctgagttccctcagtgtttattttactatcttagcgaggggagtgtagcagggcaacaggtggggagaaggtcagcagggaaacatgtgagcaaaggaatctgtatcatgaataagttcaaggaaaggtactgtgcctggatgtgcacgtaggctagatttatgtttctctttacccaaacatctcagtgtagcaaagagcgacagagcagtattgctgccagcatatctcgcctccagccataggacggttttctcctatctcagaatagaacaaatgggaatggtcagctttacaccgagacattccattcccagggaagagcaggagacagaagccttcctcttatctcaactgcaaaggggcctccctctttcactactcctcagcacagaccctttatgggtgtcaggccttatggtaaggtctttcatttcccatgaggccatatctcaggctgtctcagttgggggaaaccttagacaatacccaagctttcttgggcagaggtcggtccctgcggctttccgcagtgcattgtgtccctgggtaatcgagaatggagaatggcgatgacttttaccaagcatactgcctgcaaacatattgttaacaaggcacatcctgcacagccctaagtccattaaactttgattcattacagcacatgtttctgtgagcacagggttggggctaaagttacaggttaacagcgtctcaaagcagaaacaatttttcttagtacagatcaaaatggaatttcttctgtcttccttttctacatagacacagtaacaatctgatctctctttcttttccccacatgtaaaggcaaatataattgcatttgttgtgagagctgagggttaatctatgtaaagcacttagaacagtgccttgcctgtgatttgtactatataaatatttgctattactatctgatagcaagaattacattacattcctgggtctaaccaatagcttggctggcaatgtgtggcttggaccaagcaagatccacccatcagggctgaggagggactcacttgaaggctatggctattcagaggagagtgggcaaaataggggttaacaaggaaaaaagggaggggtgaagaatggatattgaccaacaggatctgccacacccatgttgtttaaaaaaaaaaaaaaaagaaaacctgggccgggagggatggctcatgcctgtaatcccagcactctgggaggccaaggtaggtggatcccctgagctcagaagttcgagaccagccttgccaacatggtgaaatcccatccctactaaaattacaaaaattagttgggtgtgggggtgtgcacctgtagtcccagctacttgggaggctgaggcacaagaatctcttgaacccgggaagcagaagttgtagtgagcctagaacttaccactgcactccagcccgggtgacagagtgagactccaccttaaaaaaaacaaacaaaaaaaccctctatcaatgtatgagcattattctcttcgtatgtgttctatttttttaacttttttttttttaggtaattacagatttacaaaatatttgtgaaaatgtataaggagatctcatacctggccctagcttccccaaatattaactaccaggaaattaaccttgataaaaatgttcacatattatttaactaccaggaaattaatctttatacaatttttttttttttggagacagtctcactctgtcgcccaggttgcaggctggagtgcagtggcgtgatcttggctcactgcagcctccatctcccaggttcaagcaatcctcctgtctcagcctcctgagtagctgggactacaggtgtacaccatcatgcccggctaatttttgtatttttagtagagatctggtttcaccatattggtcaggctggtctggaactcctgacctcaggtgatccacctgcctcagcctcccaaagtactgggagtacaggcatgagccactgagcccagccttgatacaattctaataacctacctatagtctttattgatgttgacagttgttccccagtgtctttttttctagtccaggatccaattcaggatcacgtactgcattgatttctaatttaaataccatttaaaaggaacactgagttccacagaacctaacttttgttgcaagatctctaggttgtttgtagagtttcatcattaccagtaaccctgggccttcaaatttttaatatatttcagagtttatcttttgggctgatccctaaaacagaattactaagtaaacagatatgaacatttttaaggccttgatgcatattggtaattgctttccagaaaattatacaaatttgatgtccctacaaaccatgtatgaatactcaacttcccatattcttagaacttcaggattttattcttgtttttaatattggcattttggttaagtgaaaatcaaatctcgttgtttaactgcattttctttatttctttttttttttttttttttttgagacggagtttcactcttgttgctggagtttcgctcttgaggctggagtgcagtggcgcaatctcagctcaccacaacctccgcctcccaggttcaagcgattcttctacctcagcctcctgagttgctgggattacaggcatgtgccaccacacccggctaattttttgtatttttagtagagacagggtttctccatgttggtcaggctggtctcaaactcccagcctcaggtgatctgcctgcctctgcctcccaaattgctgggattacaggcgtgagccaccgcgccctggctttttttttttttttttttttgagacagagtctctgtctcccaggctggagtgcagtgacatgatcacagtttactgcagcctttacctcccaggcccaagagatcctcctacctcagcctcctgagcagctggaagcacaggcgtgtaccaccaagcctggctgattttttaaattttttgtagagatgaggtctccctctgttgcccaggctggtctggaactcctgggctcaagcgatcctcccaccttggcctcccaaagtgctgggattacttgtactttgggtgcaagttagccaccatgcctggctatacttggattttcttgattcttttgagttttcacattttttcatatttattagccatttattaatttattaattgaggtcattgtgttttcacatttatttaaggtctgtaatcactccttggccttttggctaagatcaagtatatttaagttcgtttttttttttctttttgagagagtctcactctgtcgcccaggctggagtgcaatggggcgatctcggcttactggaacctccacctcctgggttcaagcgatttcttgtgcctcagtgcccaagtagctaggattacagacgcctgccaccatgccctgctaatttttgtatttttagcagagacttggtttcaccactttggacaggctggccttgaactcctggcctcaagtgatccacctgcttcagtctcccgaagtgctgggatgccaggcatgagccactatgcccgcctgaggttttctttctttctttctttttctttctttctttctttctttctttttctttctttctttctttcttccttccttccttcctttctttctctctctctctctccttccttccttccttccttccttcctttctttctttctttctttctttcttctttctttcttttttgagacagtcttgctgtgtcaccaggctggagtgcagtggcgtgatctcagctcactgtgacctctgcctcccaggttcaagctattctcctgccccagcctcccaagtagctgggactacaggcacgcgccaccacgcccagctaatttttgtatttttagtagagacggggtttcaccatgttggccaggatggtctcaatctctttgacctcgtcatccacccacctcggcctccacccgcctcggcctcccaaagtgctgggattccaggcatgagccatggcgcccggccaaggatttaaattttaaagtaactaaaacagtaattatttcccttgttagatcttctgttgcttttttctgaataatgtatgcctttaaggaataataggaataataaatgcctttaagaataacatacgcctattaaggaaaattagaatgacgcatttgttatttttagctttagaaaatcctctgctatccagattgaacatgtctttcattttcttctaattttctgtggtttaattttatatccttaaccctttaattcgggtagaatttattttggtggattctgtgaggcacgagtctaaattgctcttttgtaaatagctagtcactcatccatcatgtctttccagcatcattaatattctgtttccctctgtcactgttaactattattgcagtaatgctgcataagaagccagttcaaaactcagaagcctacaatcataagcatgtatcttgctcatgcatctgtgggcaggctgagctttagctgatctagcttgggctctgctgggctgggttgacttccaagctgtgagtgggatccaggtggctccatgtgcctttcatctcccttagaccagcaacatcagtggcgtgggaaaatatacctcgcctccattgaagtgatgcacagtcacagggtgaacggtatgtttacagtgagagatgaataactggaaactgaaatgccatctaccacacctttggagacagcctttcaggaaactagattgtgttgagataaaggcagaatggagtctagaaaatggcacaaggtcaagggaagatttttttctttctttctttttttttttttttttttgagacagagtctcactctgtcacccaggctggagtgcagtggcacgatctcagctcactgcaacctccacctcccaggttcaagtgattatcctgcctcagcttcccaagtagctgggattacaggcacccgccaccatatccagctaattttttgtatttttagtagagacagggtttcaccttgttgcccaggctggtttcgaactcctgagctcaggcaatccgcctgccttggcctcccaaagtgctgggattacaggcgtgagccactgtgcccggccaggaagtttttaaggcagggagatgctggaatttgctcttaggctgaggaaaattgcaaaatatgtagaggggtaggtagtcacagaaattgttttctctaagaaggatatttgttgaaagtaaaggaaatgacgttggggcttgaggtttggaataacaactgcagatgagatggggcctcagcaaaacggaactgccaagcactggtatcagggacttgggatggcctgaaccatcgcagccctgagtcatatgacacagcagttttcttcagccctgcccgtgaggtaggagactgtcaggttggttcaggtaggtctgaaggttggtaggttaaggctggaggtcaagggggtcaggggatcaggaagctaacaggtggtaagtagttcaagggattgagcctaagttcaaatataggtgcaagaggggctgaagggctggaagaaaacaaactgcctgaggagctggaactggaggtccatgtgtactggggatgggaggggatcagggaaaaggacattggaatttaggttctcagaggcagagaagttccaggtgaatctagggtgtggccatgtgagcaagctgctgaattatgtcgaaggcattggaattgaagtcaggaactgaggtcaaggcagagttcagaaccacctatgcgaaatgcacactcttgggccccagccaaacctactaagtttgaatctctgggggacggaccagaattccgtatttttacaagctccctgagtggttcctaggctccctaacacttgaaaactgctgtgctatgatgttgaatgagccatgcttgttggaattacctgatggcaggaatcaggcaggaagactaaaaacaggtgttgaaatccttagagagtctgggctgatcagtgtatgggactgatgaggaggggtggaaagaagtttgtacatgagtcaggaagagcaatggccttggcctggactattgctagtgcattcctttccaacctggagacaatgtaggagactaaaggcttccactgcagaaggcagggcagtgagagagaaggtagggaatagaagacagggatcatattcagtccagacaggctgggagctctgtgagaaggcagaggacgttggggaaggatttgtttcagaccaaaccagggttctgcagggtacagcaaaatggctcggacaggagttcatgagaaaatggtccacgagggaaagtgagctttggttggggataacagatgaggggatggactgggctaagcagaggccagattatcccagtcaccacttctgcactgggttcacttttctaaactgaactaatttctccacccaggtctgacaagatgtctcttttctctaacatttaaacagctccaaccatctcagctccttcatgattgtttcgtcatcatcaccatcgtcactgtcatcatcatcatcatcaccaccagtgatttcctgaatgccaaccaagcaccagtcatcaagcgtgagccacggtgcaaagatggaggcaggctctccattctaagggaacctctcaggccagtagggaaggcaagattcagacaccagggacaggcagcctgggatgacaggtggaacaaggaggagacacaagaacccccaccccaacccaggaacccacatcacaggccagacctgcatgatcgccaggcacccgactcgggttatgaaggtgtctctcctaagagagtggcagaggcaaactttagccttggcagtgcgcctcaagctgctcaggggagaagtcacggccaaagccctggagtgcatgggttctttagccatggttctcctgcagcttcctctgatattatgaagcgcctgccgccaccaggcttgttctgactcccttccatgatccacccttctgagtggggtttggcttctgtacagctctcctgtgggcactgagcccactagtcagagcaagagggctccagtctctggacagtcacagtgcttggtggcaaaacataaattgtcattcattcatgccttgtttctgtcattcactcattcattcagcagatacttaactgaacacctgctctgggccaggtattattcacaccactgggaatacagtggtgccaacacaggtccctccctgacttcatggggctaacattccagtgggagtgacagaaaagatccacaaaataacatcacattgtgaaaagtgctatgaaagtgaaggacgtaagcacagtaatattagtaatagagtagagagtgaggaggtggtgagcaaaggcctcatagagggagtaacattttttctttaatttgatgtatactttacatatagtaaagtgcacaaatcttttctttttttttttcttttttttttttttttttttttgagacagagtcttgctctgtcgcccaggctggagtgcaatggtatgatctcggttcactgtaacctccgcctcctgggttcaagtgactctcctgcctcagcctcccgagtagctgagacaagaggcttgtgccaccatacccggctaacttttgtatttttagtagagacggggtttcactatgttggccaggctggtctcgaactcctgaccttgtgatccgccctcatcagcctcccaaagtgttgggattacaggcgtgaaccactgcacctggccatgcacaaatctttaatgtacaacttggtgagtttttcaatttgcgtatgtcagactctcaacctctgtactgcagacattggggccatttgtcctggggactgtctttcttgtttgtcttttttttttttttttttttttgagatggagtattgctttatcgcccaggctggagtgccctggcatgatctcggctcactgcaacctccgcctcttaggttcaagcagttctcctgcctcagcctcctgagtagctgggattacaggcacacaccaccatacctggctgatttttgtatctttagtagagacagggtttcactgtattggtcaggctggtctcaaactcctgacctcgtgatctgcccacctcagcctcccaaagtactgggattacaggcgtgagccatcgcgctcggccccgtcttgtgtattataggatgtttagcagcatacctggcctctacccactaaatgtcagtaacattcctccccacacagttgtgaccatcaaaaatgtccccagacattgccatatatcttctgggaggcgaaatcgccactgttgaaagccactggcatatgccatgtagccagcactcagctcaagatacaggttatttccacatggaggggttggcgtttgagctgacacccaacagctaagaagctgcctccaattcagagaactggggaaggaatgttccaaggggagagagcataggcaaaggccctgaggtgggaatgagcgtggcacatttgaggaagtgtggctggtccgtggtgacaagggaaaggcatctgaggaggttgaagagacaggctgggccctattgagcaggggctttgtgggatacggttaggagtctgacatttcaaagaacgtttgtgagtatgtaatatgtacctggcactatgccagacactggagagttgaagatgaataaattaaatccttggccctactcttttttgcttttattactatttttaattgacacacaataattgtacatatttatggggcacagtgtgatagtttgatacatgtatacaaggcgtaatgatcaaatcaaggtaattagcatatccatcacctcaaacattgatcatttctttgtgctgggaacattcaaagtctgctcttctagctatttgaaaatatgcaggccagtgcctgtggctcatgcctggagtcccaactaccgaggaggctgaagcgggaggattgcttgaaccctggagtttgaggctgcagtgagctatgattgtgccactgcactccagcctgagtgacagagtgagaccctgtctctatttttaaaaaaaagtatgaataagacccagagttggcacaaaaggggacatgcttaagcccatgaaggatcctgctgggagggttcaagaagagctttcttggagagatcacacccaatttgagtctttggggaacaaagaataaatggcactccacgcagaaggcacagtatgtgcaaaggcatgggggtgtgaaacaatatgatagcttgagacaatacctaagtagttaagtattctagggtataaagtacaggagaggggtaataataaggcatcagcctggatgggatagaaaattcttatggcagaggaagtgaaactaaagcccacttgcagcagacattagaagtcttccagaacagtctaagggtggggttatggctccctgggcctgcatgactcccctaaaacactcaccctcactccttttcccagtcccgccttgactccatatgtttcatcaaacatatcttggatttattatctataatcttgttaattgtctggcttgagatttagaatttggtcatctctgtgttctctacaagctcatgcttgagcatgcatttcctgtttcagattacaggactgcattttaatttcttgatagaatgcctgatatagccttacctggcacagccttacctgcagaaagttgtgtgcacaatgacttttgatgatgcctccatgatccttcactttgcatgtacagacacagacacggagatgcaaactcctgcatcctacaagggtcatctgcaaattggcttatcagttttctcactcctctgtctcctctgcggtaccagccctttatatgccaggcactgagaagcaacctaattacaggcgaggagacagggagggagcaggccataggctctgtccctcaagatgtacccacatagaagaaactccaggtctgtctgggttttctggattaaacccagattcaggtattggaattacaattcagtttgaagataatttaacatatccctcacccatctccctcccagaacctcccagcagcagcaaaggtgagcttgacttttttttttttttttttttttgagacggagtctcacccctgtcacctaggctggagtgccgtggcacaatctcagctcactgcaacctccacctcccgggttcaagcgattctcttgcctcaggctcccgagtagctgggactacatgtgcatgccaccatgccaggctaattttgtatttttagtagagatggggtttcaccgtgttagccaggatggtctcgatctcttgacctagcgatccgcaggcctcagcctcccaaagtgctgggattaagcgtgagccaccgctcccggccgagcttgactcttttttttttttttttttgagccggagtcttgctctagagtgcaatggcacgatctcgactcaccgcaacttctgcctcctgggttcaagcgattctcctgtctcagcctcccgagtagctaggattacaggcaggcgccaccatgcctggctaattttgtatttttagtaaagacgtggtttctccatgttggtcaagctggtctccaactcccgacctcacgtgatccgcccccctcggcctcccaaagtgctgggattacaggcgtgagccaccgcgcctggccgagcttgactctttagagcatttccttcccttcctgtcctgggccagagctagggctggagccaaaacaagcccagccctggctcctgtgcctaaatttgtagatttcaccaccaccacgcctgtcctcacacctgcttccattccagggaccttaacaacttctagaatccatcaggagggcagcagtgagggagctgggaacggtgatgtggaaatcgccctgggtttgggagtgggaatgccccagccctaggcccctctgtgccacccatggctacatatcctaggtcatgttgctcctccagagcttgtgtggcctcttcctatccttcagggcaggacttatgtcgtccgctggggaggccctcccccatctaagttggccctctctgtgctccatatcattgccccctccttgacttcctttcgcaatttatcacgcgcatatgtatgtgtatgcataaacagatataattttgtttgctcgcttatttggttcgtcgcctcactagattccggactgtgggctccaggaatgcagacagtgtgcctttgacccttgcatcctcctcagagcctggcagagtgccaagtacataggaggagctagaaaagtaattcggcgaatgaataaatccatgaatggcagctgaccccgatgatctctcaggtttctgccagttgagaaagtgtagcagtgccctggacggggaggcgggcggggcgaactgcgagctcctgccccttcccagggctcaggcgactgtggaccccgatcagcgcaggctcgcggcccgctgtggccccgcctcctggccgccagccgggcggagccaggccgccccccaagccgggtggccttcggggtgcttgcccggctggaggtggtgagggggcgggtccaaaggagaggtcaatgggcggggcggggccacaacgcccccacgtccagagccggcaggcaggttccccgcggggggccggggccgggccgttgcctagcaacgccgagccccgcccggccggcgcgtgcctgcccccagcatggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggttagtgcccgggctccgaagcgtgcgggctcgggaggcgggcgcgctgggagaggggactgggaggcgggggctggagctgggggtgggcgtggcggttaggaaggggcttggtctaagggaagagggatcgaggagacggactggagaagccactgagttggggggcctgagggatttggggggctggacaattgggataagctggggaaggaggatcggagaggcgggccagggtggccacggaaggagggcgtgagaggacatctggagcaaagtgccacagaatgggctggagaccaggaagctggacagggggatagtgcaggagccagggctgggaagaccgtccctgtccgggggtgaggtcagcagatgcccgggctccgatggcaagtgccggagagaaggaatgcctcccaccgtctgacatttaaaaccgccaactcctttcgtatgtccttgtcccactccccagcatccaactcctcaccagtcaagttaggttcttctgtcccaagcaagagtcccaaccctgttggattccagtatgtccctttccttctaaccaaagcctggcccgtgtggaagccccaggctgtgaaatctgacccaactgactctgcccacttttccagtgatttgtctccgtcgaccctcccccgctcactctgccctcctgcctccctctaccccttccttcctggccccaggggagggtggtgcctagcaagcactgttcagccccagggacactgagaggcagggaagaagacaggcctccgaggccccctgtccccttcctactaccagcctggccatgggtcaggacctcaagccccagtttagggacagtaatgttggggatgggaattgtgagagccctggccacaggccaggttgtggggagagcctaagcctgggaatttcccgagcttccgagcagacattgtgcaattcaccctctcctccccagaccaccccacacgcccagaagcttcaggcgcaggattccactcacagtctaagaaatgcagatataaaggcaggataactagaaaaacatggtgctggagggtggggtggggatcttgtgtttgtgccttttggggcattcacatctctaatatcctaaaccttggtcgcagtttagataatgtgccaagtaagttaccattgctctgcacgttgcattaaaataatgagattgaaaaatatttaggccaggtgcggtggctcacgcctgtaatcccagcactttgggaggctgaggcaggtggctctcctgaggtcaggaattcgagaccagcctggccaacatggtgaaacgccatctctactaaaaatacaaaaattagctgggcacggtggtaagcgcctgtaatcccagctactcaggaggctgaggcaggaaaattgcttgaagccgggagagggaggttgcagtaagccgagatcgcagccattgcactccagcctgggcgacagagtgagactccgtctcaaaaaacaaaaaaaagaaaaagaaaaaaaaatcccaaacatgaaggtatctaaataattttcttttttttttttttttttttttttttttgagacggagtctcgctctgtcacccaggctggaatgcaatggcatgatctcagcatggtgaaacagggtttcaccgtgttggtcaggctggttgcaaactcctgacctcatgatctgcccacctcagcctcccaaagtgctgggattacaggcatgagccaccgcacccggccttttttttttttttttttttttttgagacgggctcttgctctgttccctaggctggagtggtgcagtggcacaatctcagctcactgcaacctccgcctcccgggttcaagcaattctcctgcctcagcctcctgagtagctgcgactacaggcacctgctaccatacccagctaatttttgtattttcagtagagatggggtttcatcatgttggtcaggctggtcttcaactcctgacctcatgatctgcccaccttggcctcccaaagtgctgggattacaggtgggagccattgcgcccagcccatatttgggatttttaatgaaaacattttctccccacaaaatttctgggaattttacagccttatctggggaaagatttttaaatctacttctagctttcaaaattagtaagtttgaggtcatacaaatggcctgaggaagtggaaaatagaagtttccataaggaactggaatcagaattcctgagatcagaatgccaggatcactatctcagaatcttgagggtgtgggtatgcctggaacttgagacgtgggattttacaaatctccaaaactctaatcattggagagcttcttcaaaatgcagtatttctacaggctttcctgtgtctggatttcaaagttgctttggaatccactcctcaaatttgcagagagaagggtgcgcctggagtcagaattccagaccctgctcctcatagtctgggaaacaatcagtccagtccccagggggagatgctgctggctgctgggagggaaaggagatatttgcaggaaactgtaggggggaaatgggcaggtgttggtgctaggggtgcctccaggaaggatggggagggagggggaacggaatgggacaggacatgatggggagggggagggcacatgcactaccaacctgaaggtgtggctgggaggatcgcaaatagaggattctactgggggtggaaaggcaatgatggaaacaccaggctcaccgggaggagagctgttgaccatgttatcattagtaatcatcatccctggtgtttggcaatttaataaaaggctttccttaaccataactacaattgtcttaggatgaggatagctgagcacagtggccacaggtgaaactggtgagacacatgcatttggggctctgtggggcctgggagacagtgtggattgtagcaaagcacacagcatgtggggtcgaacaaatctgcttttgcatcctagttttgttgcttagtagccatgtgaccttgaacaaataacttctctgtgccttagttgtttgcatctataaagtggggttggggatgcctacctcatagggctcctgtgaagatcaaatgaaaccgcatctaaaatacacagggcctggctcaaaaagagtgttcaggaaatgttagcaggtgttcctgatgtggcctggagttgggtgggagagtatctatggccctgtgtccttctggagcttccttacttaattccacccctgtcttccaagcctgtcctacccaccacccagcaggaaactccacatcccttcattcagccagggaacacctagctgccctaggtaaggactgtggggtcccagatatgaacaggttctgatcgctgttctgcagggaaggggaaagcacaggtgaacagatataaacaagggcccaaacccgggaggaggcaggccgtggcaagctccccagaagcagcacaatatgcctggggagtcagatcaggaatgtgggactcccccgtgcgtgccccctgcttcatgcctcagttgcccttttgccttcttaggggtagtggtgggggttttgcagaacaaagtcttgaggagagcctctgtctgcagaggggagacgaataggacacaggcaggtctgggagtgtcttgcagagccgaggaggtgggtagcagctggcctgtggagaaagccagtcctagtgacagccttccctccctgaccaagccccctctccattcctaggcatagaaggtccttcctgaccctggcaaccccccctgggacggacctagcttgctctacttctgcaagaggaaagccgttatctggggccaatgcgtcccactggcttgatttcaagagtggcagaagcctgatggaagggtccttgagtgaatcctcccagccccccgaatgaggccaggtagatgcagtgagctgggctatccatgtcgcagcctggcaggaggggagcaggatccttttcctttctggggcctgtgggaccgtggagaactgtggccagagcacccacagcagcctcatgcctccctgctgctctctgctctccccactgacacagcttccccctgctgcctggttcgtcttcaaagtgtggctctgatcaagtgtccccttctgcaagccacattgccgacagtatggagccacgcccctcgcccaggcctttgcagccttcccacaccccctacagacctgcccagtttcatctcccccaggcctgagctgttcctgcacttctgtctgacctgtcctgccttccttcctccctacatctctactgtcaaattctgttgcatcttcaaagctcaccttcaaaggtacccagaatgtgaacacttctccctgcctccactgccaccactctgggccagccaggagaatcgcttgaacccaggaggcagaggttgcagtgagccaagattgcgctattgcactccagcctgggtgataagagtgaaactccatctgaaaaaaaaaaaaaaaaaggaaactgttacttaagtcaggaatggattacttctctgctcaaactcctccggcgagttcccacctctctcatgaagtccaagtccattcgaagagtggcttcagggccctctgtgacctgcccatccttaccacatcttttagcacccttcagcctgttcctctgtctcagccacagctggtggcctctccacggtgcttcagtcctagctgagaggtctgggctaattctgtttctgccggtcgtaatcccaggcctcaaatacaccaagacaaccctaccatcaggcctttctgtggctccacatggcttgctgcctcacttccttcaggtctctgctcaaattttgccttatttgagagccctgccctgaccacctcacataaaaatagcaccaccctcacccctgcaccctgtcccctctctggctttatgttcaccctagttcacatcaccatgggacacactaaatgttgattgtttttctcccccaaccagaatatggctacacagggggagaaactttgttcaagactgtatcccagattccagaacagtgcctggcacctaggtggcccttactaaatgcctctgaatgatccttttgtaattcctaagtatgactgggttttcacacacataggtaagatgcacctccctcaaaccttgtgatgatgtcagcacggtatccgtctgatgtgaaagaaaaaaagtttctgaatgaatgcatgcgtgcatgaataaatgaatgaaaagcttggctcaggtgcccttttctccatgaagcctgcccggcctcctcagtcaaaatgaacctctgtctccagaccgcccccagcactgtcttccctcttcgagcttcccgtgcgcattcttgcttgtactggagttaggtgttcacggaccggccttcctgactgctctgtgttcctaaggggccttggggccgggcacagtggctcacacctgtaatcccagcactttgggaggccaaggcaggtggatttcttgaggccgagagtttgagaccagcctggtcaacatggcgaaaccccatctctactaaaagatacaaaaattaactgggcatggtcacgcacccctgtaatcccagctactcaggaggccgaggcaggagaatcgcttcaaactgggaggcagaggttgcagtgagtggagatcgcgccactgcactccagcctggatgacagagcaagactctgtgtcaaaacaaacaatcaagcaaaaactaaggggccttggagcagacccggctccactagaaccctgtgtccttggtggccctctgggaccctcaggcctagctcagggagcatgatcgaatcaggaaggcctgggattgcgatgagcgaggagagaaggggaaagccacaagaaacaaaccaaaactaaacaaagcccagagcccttggcgggcaggtggcctgggattacacacatggagacagaactagccaaggcctcccagccagggctgagaccatggagaggccaccagctcttactgtgcttctggtcctagccaagagccctcagcagcccctccccttccgtcagtgacagatgggcgtcctctggagagggctgtgaagtctggggaagaacctgtcctgggatgggcagggcgatggcagaccctgacctggggatctcctcttttgaccacggagcagccctgtccctctcctgtgcatgcggaagtccccacgcccccaggcatgctggcaacttcggggaaacccttaccctcaagggctttttagctgttttgttatcttcttcagtttcctcagttttgagaatgcacaaaacatggagctgctctctgcattcctgaggggcctctaagcagacctcgggtcccatagaacactgtgtcctggtggccctccaggtccctcagctctcagacaggcactttcagttctgtttcattaggagtgccctgtcgttggtgagatgcagagcctgggcagtctgggtcctgaggacatgaagggagaaaccagaacagtccccggccaggccccaccagcctgagcttgcctgttgggtcccagtggagtctggggccttgtgggatcggggggacatttaaggggtgtaggaggaagggaggagtcaaggcaggtgaccctggcaataggggctttccagatcattctgtgggaggcagagcccctgttatgctgctcccctgccttccaccctccttcctactccccctggcctgaggccggccctgggcctagctgggacagaggcttgaaaaccttcaggcttctctcagggctgcccaggatggtgaaatggccccacggaggagagaagagcttcattgtgtgttttccactgtgtgccagagggaggggcgtctgggggggcagtggctcactgtccccagctgtcccacattgcctcccacggggctggaggctcacattcagataccagagacaccaactgctggctcactgaggcaaggagtggaaggtgcactttgaccctacactggaggtgctggtgctgtctgcagctgtaaccccacagggagggtcccttggggcagctgccacttgcccaggctggctgctccccatcttgcagaatggtttttctgcctcccacctaagtcccagaggaccaattgggaaattttattttctttttggtgaggtgatgatgggtagttcctgtccccagaactgctgaatcaaaatctaggaagagggaggaggagaagaaggtcagaatctttttgtttaaccagcacccccagatcattctaatataggtgggccaaggcccatcttagagaagcactgtcctggatcccagcttgctgactgtgcctgggaagcccatggagagagcgtgaacccacatctgggcctagggcatcagtattttcttgtgagtcacatgaacttactggcccagcctgcaagggagcactcaatttgacagaaagggaaactgaggttaggggagtgagttcctgcttcttgcctccagcaacagaagaagccgtatctctggtaatggcttaagaaaccaggggccataacatggggcagtgacatcctgggaaggtgggacgggggattgaagacagaagggcacaggttccagccggacatggtggctgatgcctgtaatcccagcactttgggagggcgaggcaggtggatcacctgaggtcaggaattcaagaccagcctggccaacatagtgaaacccgtctctactaaaaatgcaaaaaatgtggtagtgggcacctgtaatcccagctacttcgggaggctgaggcagaagaatcgcttgaacccgggaggcggtggttgcagtgagctgagatcatgccattgcactccagcctgggcaacaagagcgaagctctgtctcaaaaaaaaaaacccaaaacaaatatacaggattgttttgcatgctttttatttttatttttatttatttatttttttattttagagggagtcttgctctgtcacccaggctggagcgcagtggcacaatcttggctcactgcaacctctgcctgccaggttcaagcagttctgcctcagtctcccaagtagctggaattacaggcttgcaccatcatgcccggctaatttttgtatttttagtagagacggggtttcaccatattggtcagactggtctccaactcctgacctcaggtgatccatccacctcggcctcccaaagcactgggattacaggcgtgagccaccgcgcccagccatgcttttgtatttttaatgaatatagtcatattgttttctctgtggtatgtctcagcataacaatacgtgcttgagctttgtgaatgttgaaacctgttgctctagatcatgtgtttcccttgctgtgcagttttccaaggtctgagtatgttgggatttatttgtacattttgctggtggcagtcatttagggggtttccgccctttcactcttgggagcacgggattatcactgggcggtacaggaggggaggaggcagtccctgctgtggtctcagtttccagaaggcctgactggaagttggacatttgctaataagcagtgaggagccactgaagacttttgagcaggagcaagtctcagcaaaatgcggcgctttaggaacttctttttgccagtgctttgcagtttgggttggaggtagagagctgggggacagaggctcttgtaaggccctaggtgagtttccagggcctgttctcacaggtgaggctgcgctgggggcagtggaaggcaaaattgagagggatcctgttttggttgcatatgccagggagagggctaaatgcaactgcgaggacagggggcctttcccagaaagagaagaagcaggatggggagctgaccatggggactgtcactcaccaattctgcaggcagatggagggagagcctaagctaagtggcttagagagtcctgtggaagcccttggcagggcagggcacagggctggggagagccactaggtcctcaggctgctctccccttcccttcctccttccccatctcagccctgccttctcctgctttgcccaaagatcaagacctcaggccagcaaggactgcaacctgtccctagcccacatccaagccaggcacaggtctcccatccccctgccaccccaccctctccaccttcagcaccccctctatccaggcccctgtctctctcccacctggatgactcggtacctcctgccccttttctccactcagcagcccagtgagctctcagaaagggagtctgatcctgtgcaccctgttctaacaaccaccagccattttccactctctgcatggcctggcccctgcccacctcaccaaccccttctccagcactgttggtccctccagccctgcccaaagactccgaggcctcctgacaattcctaaaattccacactcctcctgccttggtgccacatcacccagaaccgtccatgccgctggctcggtcttgcagtttccagcacgaatgtcaccctctggggacgaggccttccctgggcaccctgtctacagtagggcctcttcccttccggccactcttttccacccccagccatagttactggcagtttgctgactaatccggtttctggtttaatgtctgttggccctccctttccccacattacaagctccccgaaagcaggaccccttctgccttgtttctgctgtctccactgtgtccatcatgcacagtatttgccagatacagcgagtgacaaggaggggccttgtttactgcggcttcttggtgcagagtccctgcccgcacagatctgtcctttcttagggacagaacctgggaacacgtagtcagcatttagtaaggggaggcggggagcttatcacccctcccagatgtgcatgaccctgctctagcagctgggaggacttcctggctgaatttgggaaggaaacaacagttgctaaacatcttccacttgccaggctctcggctgagtgctttacattagttttcttattttaggcacttaatcttcacacagtccttcggggtaagtcacagcattgccatgttatagatgaggaacctcatctgtgaaactcatgacttgcccaaggtcacagagtcaacaggggccaggctatgatgggagcccagatctttctgttgccagagcctctgttctttccataagcccatgtagcgagaaatgaagacaggaatgggactcaggcatcggtgcaaggtggtgtctgtcagaggaaagggtgattttatttaattttattttttaacttttcattttgggccaggcgccgtggctcacacctataatcccaacactttgggaggccaaggcgggtggatcacctgaagtcaggagttccagaccagcttggccaacatggtgaaaccctgtctctactaaaaatacaaaaattagccgggcgtggtggcgggcacctgtaatagcagcttctaaggatgctgaggcaggagaattgcttaaacccgggagatggaggttgcagtgagccgagatcatgccactgcactcctgcccggatgacagagcaagtctcagtctaaaaacaaacaaacaaacacaacttttcattttgaaatgatttcagacttgtcaaaatagtatatagcattcccatatgcctctcgcccctgaatactatcgtctttcataatcacagtacagtcatcaaaaccaagaaattaacatcaatactatcctatgaagtattctcagagcttactcaaattcactatttttccctgctgttgccctttctctgatctagaatccagtccagaatcccacgttgcatttatctcctggtctcctccagtctgggacagtttctcagtctatctttcatcttgtcaatacatttgaagagtagagcctgggcaacatttgaagagtagagcctgggcaatcatctctatactaaaaatttaaaaaactagctggcatggtggcacgcacctgtagtcccaactactcaggaggctgaggcgggaggatcgcttgagcccaggacattaaggctgcagtgagctatggatcacatcaccgcactcttgacctgggtgacagagcaagacccaaaaaaagaattatagatttgcatttttggcacaaataccacagaagtgatcttatgccctcctcagtgcatcataccaagaggcaaatgatgtctatatattgttactggtgagattaactttgatcactggcttaaggtggagttagccaggtttctatggcctttataattagtggttattttgtgaaggagatactttgagattatgcaaatatcctctttctcatcatacttgggtgatttgactggggtctccaggtgttaagagtgtgctcttgtgtgttagaaactctcggtgttagcctgggagcgaatcaagacatcttctcttcaaaaaaataataaaaataattagctgggcatgtctgctcatgcctgtagtcccagctactcgggatactgaggtggaaaatcgcttgaaccccagcgtttcaggcttcagtgagctgtgactgagccaccacactccagcctggctgacagaggaagatcccatctctttaaaaaataaataaataaataaataaatataaatataaataaaaatgggctgggcgcggtggctcacgccagtaatcccagcactttgggagactgaggcaggcagatcacctgaggtcgggagctctagaccagcctgatcaacatggagaaaccctatctctactaaaaatacaaaattagacgggcgtggtgtcgcatgcctgtaatcccagctacttgggaggctgaggcaggagaattgcttgaacctgggaggtggaggttgcggtgagccaagatcacgccattgcactccagcccaggcaacaagagtgaaactccatctggaaaaaaaaaatgttaattgtcctgtctgtcctactagatagaaccttcacaaggacagtgagtttgccttgctcagtgtgtgttcagtgcctggccaatagcaaggattcagtaaatattgttgaagaaatgtaagttggccaaatctaatttagaaataaaaccaaaaaaaaaagaaggcctacgaaaaaggaacataaagacaaataaaggttggcaaagcccttcaaccatgtgcccagattgccaatcaatataaacccatgggtacatagagcagacaatgcagtgattaaactttacctaaatcatatctacaaattgccatggaaacctgcttggttttgacccaactgcttgcagacaaatcagctagctctccccttaggggtctgaagagcggctgcccctgctcccacatacacggtcaatccttgtagagacttagggtcagccaggcgtggtggctcatgtctgtaatcccagcactttgggaggccaaggcgggttgatcatgaggtcaagagattgagaccatcttggccaacatggtgaaaccctgtctctactaaaagtacaaaaattagccaggcgtggtggtgggtgcctgtaatcccagctactcgggaggctgaggcaagagaatcacttgaacccgggaggcagaggttgcagtgagccaagatcgtgccactgcactccagcacggtgacagagtgagactccatctcaaaaaaaaaaaaaaagtttggaaaaaatagccattaaaagtactaaaatatgaagctttttttcttctacaatctctattttgacctgtgatgtttttaatttgctatttaatgtcattctaagtaagaagcatttaaattattagcaggaattttaccatttgcttaatattgtgcaatgcctgttttaaatacaaatataaggacatttaactcctgtagaatcacagaaacgacataattaatatttcttagcttatacatggatgtgtatttagttcttaccaggagagggtctcctctgtcactcagactggagtgcagtggtgcaaacatggctcactgcagccttgacctcctgggttcaagtgatcctcccacctcagcctcccaagtagctgggaccacaagtgcatgccaccatgcctgcctaatttttgcatttttagtagagacagggtctcgccatgttgcccagtctggtctcaaaatcctgggctcaagcacttcttccatcaccacctccgaaagtgctgggattacaggagtgagtcaccacacctggccttcaattctttttttttttttttttttttttttcagacagagtttcactcttgttgcccaggctggagtgcaatggtgtgatcttcttggctcaccgcaacctccgcctcccaggttcaagtgattctcctgcctcagcctcccaagtagctgggattacaggcgcccaccaccacaccctgttaatttttgtatttttagcagagatggggttttaccatgttggccaggctggtctccaattcctgacctcaagtgatctaccagcctctgccttccaaagagctgggattacaggtgtgtgccactgcacccagccttcaattcttttctttttttttattgagatggagtctcactctgtcgcccaggctggagtgcagtggtgagatctcggcttactacaacctcagcctcccaagtagctaggattacaggcgcctgccaccacgcccagctaatttttgtagttttagtagagatggggtttcactatcttggccaggctggtcttgaactcctgaccatgtgatccacctgccttggcctcccaaagttctgagattacaggcatgagccaccgcgcccggccttcaattcttaatacgtgcacattctgccagcactgttggcttgctagttaataaggaaggatggaaaggaaaaggatggattggttaccctatcttccctttcctttctatatcgctatttgcagcataaataggtggataacacaaaagcaagaaaggatgcagcagagttccttggtcattcgtgtttcttagaacacctctgtctttgtgcacttgaagcacgttctagtttgaactgaaagcttggcctcttgggtcagtcataggtgtgcactcgccttgtacttgctttgagtcttgttgaactcccatgcgttgtgtgtcccccagatttgtgtgctcatgggcattgcagactctgtataggtatgataagcgaggaacggagcacactcactgtgtgtgtctcttgctccctgcatgtcccactgtcctatcaggctccacttgcaagacacaaggtcaaagataaaatcattaagaatttcagggtcgggcacggtggctcacccctgtaatcccagcactttgggaggccaaggtgggcaaatcacgaggtcaagagatcgagaccatcctggcccacatggtgaaaccccatctctattaaaaatacaaaaattagctgggtgtggtggtgcacgcctctagtcccagctactcaggaggctgaggcaggagaatcgcctgaacctgggaggcagaggttgcagtgagctgagattgcaccactgcacccctgcctgacgacagagtgagactccctctcaaaaacaaacaaacaaacaaaaatttcaggcttggccaggcacagtggctcacacctgtaatcccagcactttgaaaggccgaggcaggcggatcacctaaggtcaggagtttgagaccagcctggccaacgtggcaaaaccctgtctctactaaaaatacaaaaaattgccgggcatggtggtgtgagcctgtaatcccagctactcgggaggctgaggcaggagaatcacttgaacctgggaggtggaggttgcagtgagccgagattgcaccactgcactccagtctgggcaacagagcgagactctgtctcaaaaaaaaaaaaaaaagaatttcaggtgggacacggtggctcacacctgtaatcctaacactttgggaggccaaggcaggaggatttgttgagcccaggagttcgagaccagcctagacaacaaactgagaccccatctctacaaaaaagataattgggattacaggtgcccatcaccacacccggctaatttttgtatttttagtagagacggggtttcaccatgttagtcaggctggtcttgaactcctgacctcagatgatccacctgcctcggcctcccaaagtgctgggattacaggcgtgagacaccacacccagcctcagatgatttttttttttttttttttgagacagggtcttgttttgtcacccaggctggagtacagtggtgcaatcatggcttactgcagcttcaccctcccgggctcaagcaatcctcctgcctcagctacctgagtagctgggaccacaggcgtgtgccaccacgcccagctattcttttttttgtgtgtgtagagaccctatagggcacaatgttgcccaggctggtctcgaactcctgggctcaagtgatcctctctccttccctcccaaggtgctgggattacaggtgtgagccactgtacccaaccttcttcagatgattaggatgcatgctaaagtctgaccaccactgttctttctgaaatattttttctacctcatttcagcctcctaattcctactccttcttccctgcaaatgtcacttcatcagaggtgctagaccctgggctagattaaacccctcactctccaagtctctctttttttttagacagagtctcactctttggcctgggctgcagtgcagtggtgcgatgcccaattctcctgcctcagcctcctgagtagctgggactacaagcgtgtgccaccacacccgactaagttttgtatttttagtagagacagggtttcgccatgttagtcaggctggtctcgaactcctgacctcaggtgatccgcccacctcggcctcccaaagttctgggattacaggtgtgagccactgcgcctggcctctccaattttcttctgtgagttcctcagttcatgtctccctgatagattttgagttctaggtgtgtccgtctcattctccatcttgtcctgagtgctaagcagggcaaacagtaggcacataataagtgagagtggaattgcattggctcacagggtcaccaaaggaatggagatgtggggcctgcaggcatcacgaaggagtctaggggagctagggagaaaaggctaatcataggccacccactcgccctctaggtacagcctgtacacccgcacctggctcgggtacctcttctaccgacagcagctgcgcagggctcggaatcgctaccctaaaggccactcgaaaacccagccccgcctcttcaatggtgagctctgactgccccggccagcatcccccattctgtgcccccaccctccccgcctgctccccttcacataccccagcccctgggctccctgcctgttaccccgcccacagcccatctctgtccccaggagtgaaggtgcttcccatccctgtcctctcggacaactacagctacctcatcatcgacacccaggcccagctggctgtggctgtggacccttcagaccctcgggctgtgcaggtgaggggagggcagggagcagggggtgcctggagtcaccttggggactggcagtttcgccttgctagagagggctgacccttgtccgtctgcccgtgggatgtgtcccatatgctccatgttcacacgtgcacatgcgcacacatagcctggggaaggggggtacagggcatggctgggcagaaggggagagcaggagtgggggatgcagagccagagggctgggggtgttggcccaggactctgggtctagtgagtttccaggctggctttcactcccattggcccccttcagaccccctttctttctgtcacctctgtctgtcagtatctgggtctctctgtctttccctcccattccttatctctctgtgtctgcctctctctatgtacaagtgtccctctgcctccatgtgccccgtgcttcacattcctggatctctcccctccagctccatccctttcctctgcttcatctctccatgctctcctctcctctccaccagcgcccacactcctggctcttgctgcttcaagtgcctcttgcatcctgctccccagtctccaaacctcctctctctcgcaggcttccattgaaaaggaaggggtcaccttggtcgccattctgtgtactcacaagcactggtaaggggctcccgtcttccctggcccacccttgtcccagctgggcttgccaggactgggcccattgaggacggccggggccagagatcaagaagtcagtacgggccggcacccgccttcctcgtgaagtcacctggacaccagcagggagggaggagaggggacagtctcccaccactccattgatcaagcttctgaagccccagagggcagggcagtcatttctctttcatttcatgggcatgtattagatacctactgcacactgggcatggacaaaagttatgactcttccatcaaggaaattctaagaccaataggggaggtagccctgtatcaaagtatataacagcggaggcaagagggttgggagttcaagcccaacctgggcaacatagtgagaccttgtcttcaaaaaagaagtatgtgatatttaggtaacagttggcacagggaacagggatgggaggcccaggcacggtgtgatcagatccacttggagaattgaaagatgatgacctgagctgagggttcaggaagctcggctggcattggccagcttgagttgttgggggcgatgttctgggcaagggaacagcttgaacaaaggcctagaggtgtggacaacttggcttagtccagaagccacagccccagcacttaaaggcctggagatgctgtggtaaagaagggggcttaggtacagttgcccctcgaagccccctgcctgtctctgctgtcctgcagggaccacagtggagggaaccgtgacctcagccggcggcaccgggactgtcgggtgtacgggagccctcaggacggcatcccctacctcacccagtaagtccctgacctaggcaagggatggcccttccatgggccctttcccccacccccagccttcagtgaagtgtttcaggggtatcagcaggtggatctttgccagtgcccttcctggcccaatcccagcctatctgaagactggcactgcccatcccccaactgatccagccatagtccccaaaagaggaaagggggagggttcggacctgagacccgaggcactggggtgacttcttttgtatggaagcccactctcttgtgaatcacccagccccttgggcctgggatggggacagggatcagcatggcacagatccaataccttctgtcccctgctcccttgttccccagtcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtggtgagtttccccgaaagagagaggagctgggagaggagggagagacagaagccagggcagccacagtcccatggagagcactgaagccttagttttagcacagatgttgccgtggcagttacttccatctgtgttactcagattggttttaatccttgagacttcccttggggcaccttgggaggctgaggcaggaggatcacttgaggctaggagttggagaccagactgggcaaaatagcaagactgtctctacaaaaaaattttaaaataggccaggcgtggtggctcatgcctgtaatcccagcactttgggaggctgaggtgggaggatcacctgaggtcaggagttcaagaccagcctggtcaacatggtgaaaccccgtctctactaaaaatacagaaattagccgggcatggtggtgcatgcctgtaatcccagctactagggaggctgagacaggagaactgcttgaacccgagaggtagaggttgcagcgagctgagatcgcgccactgcactccaacctggaagacagagtgagactctgtcacaaaacagaaaaaaaaatttaaataatataaataatataggccaggagcagtgactcaggcctgtaatcccagaactctgggaggccaaagcaagtggattgcttgagcccaggagttcaagaccagcttgggcaacatggtgaaaccccgtctctacaaaaaatacaaaaattagccagtgtggtggtgagcccaggaattcaaggttgcagtgagctatgattgtgccactgcactgcagcctgggcaacaatgagactctgtctcaaaaataaaaaagacttctgccagctgcgggacagaatgggagaatgtctgtagctgagtaaagccctgcagggaattagtttcccctgggtggagactggttctctgatacagtgactggcaggactaggttatgaaaagttaagaacagctaggtgagtgggtgggtgaggatcacaagtcccaggctgcatgaaatcccaaagggcagcctaggcgaagaagtgttccgtgggaaagagcagccctgcgtctaccaagcctggggcctgcagcccgaagattccacagcccctcccttcaggtgtcactgtgtgcaacggaggcctcggatgggcttggtcagggggtgaccagttgggcccagttcccagtgaggagggaatagatgcctggggtgggtctggaaagtgcacagtcagggctgacggccagccagagcattacaagctggttcccacctgtctgggtgtgccttatgccatattgtgttatcctggcaccttgtgacataccctccaacccccacccagggcggacctttgagggcaatgcagagaccatgctgagctcactggacactgtgctggggctaggggatgacacccttctgtggcctggtgagacacccccttactactccccatcctccagccccacgctcagcctgggacaagggccttcccaccccctcactcccctagaaagcaggccagcccagttcctggcccagaagcgacacagctccacctctaggggtagggacagagttctggcctcccttcttcctggagtgctggctccgtaccacctctgcttctcacactaccttcccctgccagtcagccttcagcctcttgggagccttgcaggccccagggcattccagagagatgtctaattgttcatagccttagcccagaacagaaaatagcctttgcttatctggggagaagtcagtaaatccactctgcatgtaaccattgccttgtggtgcataaaaacattcacagatatctgttaatcctcagaacatatattcattcattcattcattcatcaagtactttatgtgcacctaacacataccaggctctgttccaggcaccaggaacacagcaggtacatctgtgtctggtggcatcattgttctctccacttgccaaatgagaaaattgtgcctcagagaggggccatgactagaccgaggtcacatgctaggcttggtggagtcagggctagatgcaggcctgccagctccaggtctagtggttttttcccctggaactattgccaccttttcacccatggctgacttgtgcccacagttagagaagcagctcctggcagttggggttttcctggaagtgctgacctcatccctagttgtcaggtgcccatcagcctggacctggggcagggaagactgttctgactgtaccaccaatctctctctgctctgtgtctcaccctcatggctgtcggtaggtcatgagtatgcagaggagaacctgggctttgcaggtgtggtggagcccgagaacctggcccgggagaggaagatgcagtgggtgcagcggcagcggctggagcgcaagggcacggtgagggactcggggtccaggaggagctgtgtgggcaggcactcagccccaacgggaacccatccatgctgaccccaggcctgcgagcacctccccaaaactctgacctctttggcccatgggccctcaagtcagaactcctgaactccaggatggggcaggggtcgggtcaggcttctctgtcttgggtccatttcccagcttctctccaccaaacctggttcctctcacccacagtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaaga

SEQ ID NO: 1170 - DNA, 18365 bp, Homo sapiens
agggttttaacttctagacataaactttattacatttatagttgtatccctttgtgtgatatagttaggatttctctattaagtaattaatcctaactatatccttgggctgatttgatttctgcccccacccgacagactgacccttgtcccccttccccattccagctcaaggcacttaatattacaaagaaggcagtggctggctggagagatgggcctcaagtcagaaatcccccagtgcaacttaagacaaacagagagaagtcaccttcctcttaggaccctccctgggttagcagaaggaaagaacccagaagtcttcagtaccacagtaggcttcggtatctccctagccaggtgagggacccccaggcattctccctgcccgcaccgagtctctcttcaccctggctacttcctggccacacgtatgactctgccccttactttctgctctgagctgcctgaatacaggaagcaagagttcactctgaccagagatccagaagcctgcaaggaggccccagcagctttcaagaatggggagcagatggccacatgtggcctgctctgtcttatagcgtcacaagccaggagcaagcccaggggagatgctgttccatgctggcctgtataggttactttgctcgttctgttatctgtcccccatccctaacccagataaacaatacatatgtcactgaaacaagaagggattgaagcaaggagacccatgggcacagatctcttctaccttcctgagctaaaagatgccaagccaaaggaatacaggataatggcctatgtgtccaggaggccggggacaaagctctctggctttgctgggggaagaaatagctccaactacgtagtcaagaagcctgtgacagaggtgggaggggaacctcgtgaccttgaagtcacttctacctttcatattcccttctagctatcgaataggctcttttcatattcctcacaaccccagctgttaggaagaatgtggtgtcatacagtaggtggcggggagaagacacatcttcagcctagtccctgccaagcccaccaagagcaacagttagtccctagctcctccgtccccaccaagtacccacacatccatagccagagaggccacctgtctccaggacagaaaggaaactgggcatgttactcaaggggaaggaaaggggcctaaagcccagaccacagtcatagggcccagccctctagcttggaagggagagcccaggatcgggtgaaaatgggggcttgctccttaattgcgatcccccatcagctgcagcacaaaggtgaagatgtagatgatgtctgtgtaaatctgcagggcgccagtgatgtagtcctcggggctgatggtgtgcttccggttccccaggaccagctgtgtgtcgtaagccaggaactgcaaggatagggaagccagaagtgagaactcaggcatcagtgtccagagctcatttttggtcagcagatttgtcttgggggcctatgcgccacacagtgcttagggccacattaacgcacagcataacatatgggctctatactgtagctgctcacagtctaggaaaggaggcagacacaccgttctcaatatggctgactagtgttctaatagcaggcagcttgaacaagagatggcaagagtgcccacaaaaatcaatggaatctctggacagtagtgagaggaatggcctgctatggccccattccctgcctcccaggcagtctaaattcatgcccccttccctagattcctcccctcatcccctcagctccccttcctagagtggggctgggacttaccagggtgaaacaaatggcccccagagcagcatagagcatgtggagccagtaaacctggagaagaaggggacagagaatggcattagaaacctcagcaaaccacaggcccacaggccccagcttcccccgggatagtggcatgagagtgggtagagctgggaagctagctctccatgaaaggctactgcctttccagatcttggaggaaattaagactggtgatatatccagcagagaaagcagaggccatcctgcaatggctgtataaaaccaatctccaaagccagtcaaggtacacaagtgtctactatacttctagaaaaaaagcagttgagttacagctctgaaaggggcagacccagcattcaatagaccagttcctacagcccagcctgggaggggtagactaaggaagaagggaggccccccaacccctctggtgagtatcaaaatccgggagcacccacaggacagcccacatgacatgcccacaggtggccgtccacagaaggacagagctggcccatgggcaggcagccctcgtgtccccatccttccccttcggcactgttctcccccagctgaacagaataaaggaaataattggatccagagacccccgcaaggtcccttccacctaggcccatcatctcagtcctctgggttcctctcccagtctgcctccgagaacctgattctcagctgccagccagattgaacccaccccttcccctaggagtgcagtgatgcagtccagggcttcaggtgctctggctccaaggccgcccatctccacacagagagtctaccctcacccagaaggatgctgcctccacgttggtgcctttgctagccagtcgagaggttctggaggtcagagcctgccccggggacctttggggcctgcgagaccatgctatataggaagtctgccctgagcactgggttccctgaccccagctctcctgggacactcacgtattggaagtagagcacaatgctagtgacaatcccagtcaccaggagcacaattcccaggacacagaagaggcctgtgcacgaggtgaagtccacctgccaggaagcaagaaagaggcacctgtcagatggctgtgacaaccagcccagtcagactggccctgccagggagtcccagtgctgcctcctagggggtatgggaatgtccacaacattctaaggacagaaacaggacacagttttgtaggtgcggatgaggagaaggggatcaggtctctagggaacatccctagtgtgccggggtccgggcctgataagaaaggggagtcggggggccagggaagggccctccatgccctcaccttggtctgaaagcagaagatggtgactgaaatggataccaccgcagtgatgatcattgcaatgatgacggctttggtttggtacatactggggagaagcaggagttacagacaagaggcattaagccacgtatgaatgacttcaaaatcaccacttccagaggggacctgcccagaatccacccacgcagctggctgccggcccaggaacaccccactccccacaatacacatttcccaagagtggtgctttatccctgaatgtacctggaaatggtgcccgtcatgaagcccatggcaaaagtctaagggaaggagagagacaagaatgaaacacttaaaaaggaaggaaggcagggtgctgggggagtggccatggtggcctctgccagagctggggaacgccaccaagttggaaagaggcagccacagaggagatcagaacaggcggcccagataaggtggaggagacagccaggacatccttctgaaatgggtccccatcccttccctgggagcagtctccctcacagcatctccacaccctcctgccacccttctagacttacaaaaagggtcagcagaatgatgttccatgggaaacggcgtctgaagggaaagagaagccttgattaaatgacttggggcccctcaggcgtcagaggctcctacagcagaaggaagcgcttggctcctgtgcctggaggattaagccttgactccaaggagggaggttggcatggcctttggcacctgttcaggtgtggtacgcagggacaacatgggccaatgagacagacctgtgttgtggcgccagaaacacctggattggtttgcaactcttaaactgactgcctgtgtgatggggagaaagttactcagcctctttgagcctcgggttcttcctatttgttaactggctaaaatgctacctgtcttgcagggttactataagagtgacagctagttagctcctaaacacacatggtcctttgtatacacctgaacagtagctgtcatcgtcatcctcctcctcatttcttgtaagtttccattcagctgctataaaggaatccttctttccaaaatactcggcccccatcccaatccctgtcacccctctcactgtgttaagtctctgggactcacctgggtccctggcagcaggcaaggatcaggtaggtgacaacgaagacagcactagggacaaagagatggggaagcagttcaggcccaaatctgccccgcttggcagcacacaccaggccagtgatttggggcccaaatagccgtttggaagtctgaggggaagcaactcaacaggaagcaagaacgagattacccccagccagggtcactgagatgctctgaagcaccaggctccggccaggaaggaggtctggggaggctgcagctgacgggctgagaggacatgggggctgcagcgcagcgtgcacgccaccaccagcaggtcccactcttgctctcgagttctaggggtctgctactcatctgggcacgcacacccacaccctctggcacgggaaactggcaccaacttgggggccctctcaaaaagcattttgatcctgccctgagcaaagctggtcacctagaaacagaagctgccacccctgcctccctgcccaaccacagaggagcacacactcactaggacacgtagtagacagccacatttctcctcacaaaggcgctgacaggttccctgtggggcacaggaggacaggagtagtcaccctgaggcttgtctgccccacccaggccagccaggcagccctggcttcaccttctctaattgcccatggtcaccctgagagcagggcccaccgccacccacacccccagcaggtgaccctgaacccccagggcagtaggagtgggtggcaaagcctagagacttacacaaaggtgaagatagcaatgatggccacagtgatgagcagctgcacggagatgatggagtaaacctggacacagacggccgggcatgggtcaccatccggcacccctggcctgccccaggaagctgccagcccccagtactttcctcccactcaagaaccctccctagctgcagcctggcccagaggcgaccccagtgagatgcctggctcagaggcaatgtgcacttcttcctcagccccgctcccatgctccctgccatctcccctcctgtccaacaccagcctcggtgactactgacttgccctgcctggccaccatactctaccagtatggcctctgcactcccagcagctcagtctgcacgctctatgcagctgtgagatggagagggtgggttacaagcgagtaggatcatttctggctccaagctgcctatagtctaaagggagaaagatgtctggggaaggcgggcgctgtggcagaacccacctaggagattctcccagactgaatgtgtcctcccaaaacatggtcaagaagagaggtgcaaaaagagagggaaccctggggttagagaagccaggtgcccctctgagaagcagacaaggctagagaagacaggcagccagtgtatttcatggaattgatgccctggggctactgtggcctacccacttcccattcccacagcctgaggggccccaggtacacccacctcccagcgcgtatcttacctttcggataaaagtgtgtcgcactttccggtcatcccactctccaggcccgaagctatcactcactgctctctcctccccatcatagccatggcctgggcctagggacagatgacacttgactcagctggggacctgagacatgtggcgtcaatcccaaagcctccctgacaatctcaaagtctcagggatctccagccaaaagacaagtgttataacaggaactcttctcccaagctggggtcttctagacaccctcagagtgacccagagccggcctgtcacgagggggcttaggtgggaaacgttcctcacgtgcatctgtggagggctcctgtgtgcccagcccacgccactgggggttcactggggggtcacgatgtagtggggaagccaggcaggagcaggtatgggcatccactggggcagccagccagggcagaacaggggatggggacagagggtaggagaaaaggagggcggcagagcgcagtttgtgcagcagcagggatagaggtgaagacagggatctgcatcagcctcacagaggcaggtgtgcaaagggtgtgcgtgactgtgcaggacccatgcgcagatccgcaccagcgcacatgtccaggtgagagctggctgacacccctctggggttcagagatgctgcagggctgcaaacattccctgaatgcctgaatgcctgaatgcctctttgggaactacttttaaaatccacgcttgagccacccaggaagactcactgcactctaacttcacctcatttcctttttttttttttttttttttttgagatggagtttcggtcttgttgcccaagctggagtgcaaaggcgtgatctcggctcaccgcaacctccacctcccgggttcaagcaattctcctgccttagcctcctgagtagctgggattacagacgcatgccaccacgcccggctcattttttgtatttttggtagagacagggtttcaccatgttggccaggctggtctcaaactcgtgatccgcccatctcagcctcccaaagtgttgagattacaggcatgagccaccgtacccggcctctttttttgttttgttttgttttttgttttttttttggttttttttttgagacagagtcttgctctgttgctcaggctgaagtgcagtagtgcgatcctggctcactgcaacctccacctcctgggattgcaagcgattctcctgcctcagcctcctgagtagctgggattacaggtgcacgccaccacacccggctaagtttttgtatttttagtggagatggggttttgccatgttggccaggctggtctcgaattcctgacctcaggtgatctgctcgcctcagcctcccagagtgctgggattacaggcgtgagccaccgcggccggcctcacctcatttctgaccaaacacaagcatgtccctgccatgatgtttaccaaacttggctccaaatgtcttttgcaaaagtcagatttcactttaaaggatgaggaaagtggttcaggttcccaaaggagttcctaaggaagtcgacaggtctgggaggtggcagcagcttgttggccgcttgttgggaaacagagctggtgccctgaggtaacccctcaggagtcattacttggcccagccccattctcctgtggtgtgtacgttctgggacatgcctcatggatctccttgaacaaagggggcagcaagtggctgggggccagttgctgaggcaaaaagtggagggtaacaaagacagaaacagagggagagatctcaacagagaagatgagaaagggatttaagggaaactagaagagaaaaggggcaggaggcggtggcctcatctgctccaagtgctgtccctcccacccaccttccatctgcccttccaggactcaccgtagttcatgggcatcgggtgggtggggggcatgggctgtgggtagccagcagggtgaccgtagccaggctgcgggtagccagggtaggcaggataccctcctggcaggacagatggctgcccatagcccccagggggcggagggcctgggtacagggggttgcggtcttcatatggtggtggggcgctggggttggacatggctgctcacgggctgagggggaaccccagctgctgggacctgaaatgggagaggagaaaagcaatcgtgaatgcccaggcccagctcactcagcctcatgggcccacttccagccttgtccaggctgcctccgtggagaggaacaccacctattttctccttagagggcagcgtgtgatttgctgtccacaggccacctccccaccaactgggctcctgtccctcctgcctttgcgcctgcttcttgtccacaggcctctcactgtgcagctccccagccataggaaagcaggaggaaggattcgctgaggagagagggaaccagggagcctgggaactccctgttgtggtttaagaaaaccttccagttttggtggcttgatggcagaaccagcgaagaagccagatgggccaggcacagcctcctggcgactcacagggccagctgggaccctctgaaagggtcagctctgcccctgccacagctgacggggatgccaggcctggaagccagagctgggttggagccaaggctcaaagtggagagccgggggaagaagtggaggaaaacaagctagccccagtgccagagctgccaggccccgaggaggaagggatccagggacccgggggccagtggcaggctgagtcaggaagcctgagaagcaggagtgggtggtacaggggctgggggcagggaggctgtgccaaagggccagcttgagacaggactttctggttccttcaaataacagcggtggcgtgtcagaaaggcatgcggcagcctgcgaccacagctgctctctggccttgctagggaagagagagtgagtgcacggcccctcgccctcccccttacccccaccctggagggggagacagatgttctgaatcccaggctctctgtgagttctacctgtcttccaggtgcagtgctagcagggaggacaaagagctgaggagtcaggccacaaggtcaagggaatgccttccctgcagcaggaagagccccatagccaggggagggccaagaaaccagggggagggaaccccaaactggagttggaagggacctcagggccataagccccaaatgctcacttcagatgagagaatgcaggccctgaacagggaagtgattccccagaaccccagaactcgcaggtcagtggcataaccaggacggaggccttccagatcctgggtccaggtccttcatgttatgcggtgctcttatgcctcctctgccagttactgtcctctgggcctggtggtcccctctgaggtagcagagatgcaggcttaggaggagctaaggaagcccctagagggcccctgcatccccagtaaggacaagccctggcagtctgggctcgacagggccaccacctcttctagagcatctacagggggctttaggatccccaaggaggacacccccagatgcaggtcagcagacaccagaggctctcagaggctctgctggaagcaagagagaccagcgtctctttttagggcacattgcatagttcggggatcaaataaaggactgtcttatctcttctcttttatgacaactgggataattcagagaggggaaggtggcagggagggttgaggagggggaattgaataaaagtccaggtctctaagtgggttattttgaggaaagctgttcttcatctccctagaggggctgggatagaaccagggcaagaatgtcaggtcagaaatacaaagctggcagggtgcggtaactcacgcctgtaatcccagcactttagaagactgaagtgggcagatcatgaggtcaggagttcgagaccagcctggccaacatagtgaaaacctgctctactaaaaatgcaaaaattagccaggcatggtggcatgtacctgtagtcccagttactcaggaggccgaggcaggagaatcacttgaacctgggaggcagaggttgtggtgagctgagatcgcgccaccgtactccagcctgggcaacagagtgagactccatctcaaaagaaaaaaaaaaaaaagcactggccggaaaggctctgtgggcagaaaccccaaccgtgatgtcaccatgacgtgtcccagcacctcctcagggtgcacctctgtgaaataaggtgggggcgacacgacctctaagcccactgccccctctaacaacagactatgattctgggaactcggctctgcagggcctgacctttgctcggccagagagctgcccctgctccctcctctgagccaagcagggcaaacagctaactttccagaccaagggactgtggcagccaccgggtgaaaggtgcctcagagagaagggtcagcctcggatgggccacggggactccaaggttctggtgcagctcagcgggtgctgactcagagcttcactcctgcctctcttgcccctccctttcaggcttttggtttcagaagcatgtgctagtaggcctgcctgcactgcacacagcagtttccaggccagtccttcgggtacctcagccaccagcccatccacaccagaaactaccatgaccatttcaactcactatgcctcagtttcttcacctggaaaatgggtctcacactagtaatagtaccctccacggggttgctataaaaattaagtgagaaaatacacatagaaggctgggcacagtggctcacgcctgtaatctcaacactttgagaggccgaggcaggtggatcacctgagatcaggagttcgagaccagcctggccaaatggtgaaaccccgtctctactaaaaatataaaaattagctgggcatggcagcaggcgcctagaatcccagttactcgggaggctgaggcaggagaatcgattcaacctgggaggcggagattccagtgagccacaatcgtgccactgcactccagcctgggtgacagagtgagactttgtctcgaagaaaataaaaaagaaaatacacataaagtgcttagaatgaaacccgacccctgatcaatggggataaaggttggttattttcattaaatccttacaacagtccagcaagttaatactgttattattattcccatttacaaatgaagagattgaggcacagaagaattaaatcacttggccaagataacctagctagagtgtgatgaagtcaaaatgagccccaagactgactcccaagcccctgctcttaatccctaacctgaaaacaccctgtctatccaaccttctcatcacttctgccatagcttccatctaaaaccctctcatgggttttagcctcaacaggaggctgacacaagtggaagccaaactactcaggccctccacaccaccacagggctcacagcctggccaacggccccaggagaagagggtggcccaggcttggagatacataaaggtcagagctggaaagaaactcacccaaggacagccaacccctcactttaccaactagacagccacagcacaggaacctgtccttggttaccgagctggtcctggggacaggacgagatcctagctgtctacatagagagacctgggcacaggagaggaaaccccagcattaacgctagccaggggagttgctaaactcagccacactcacctctgagcagtgccaagaacactgtcagactggcaagagcctccggggaccagggctgccgggtttggcagctttagagcctgctcttgggcttctgcccagcctccatgagggccctggccacttccacatcagcaaggcctccactagggatgaggtttggggctggcatctgcctaggtagcagcaaagggggaaagggtcagtgtttactttcgtagctatgtctaagggtggaggctagagaagaatggagggtaagggaaggagggagaaggggagagagatcacgagactgacacagagtgaggactagaaatcagatctgggttctgccagcagctactagaggggctcacagtctgcagggactttaaggtccccactggaagcctgaattttcccaaaatacagtaggcattcaccttctgcttgtttttgtttttctttttgttttggtagaaacggggtttcaccatgttggccaggctggcaaactcctggcctcaagtgatccacccaccgaggcctcccaaagtgctgggattacaggcatgagccactgtgtctggcccaccttctgcttgaaggaactccagcaacatggagcaagccccttgtctgcagacagctcgattagaacattcttccttgcctcacaatgcctgttatcaaggcattcagactgtgccctatccttgcccattatagatctaagtttgctcctctctcagggccccagtcccccattaggaaggaaccagagcccctgctttctaccacagcagcggcacaagtgggtgagctcagacagcaggacttgctgggtgtcaaggttttcagatgcagaggcggaagcacctcctcccctggagccctctcagtgtggtaatcctgctgtctgcctactgaggccccggctggggctctcctgggggtatttgaagggttaaggctccggaatctgcagaggaggcctgagctactggggttacagcaagaggagagtatgtgtactggagggagggatggaaaggagcagctgactggtccaggcagcctgccctcctccctgccagagacggatgcccagagtggaaaaaaatagctcagaatgcacatctcaggaaaccccacccagcaggcgcaggagcacagcccagatctgacgatttgttcccctcccttttcctttatctgcccccacaagaaaacactttatcctcctaccccagggcacagctgacctcatagccacgagagcaaatgagtaaaaagatacacccaggagtgtctgggcaagtcaccaggcctgattctgcaccaagggggcccagaatcaactaaatatccttccatcagcctggactttgggactaagaggatgaagccacagggatctaaacactaaaatatcagagctggcttagactttggatctcacctggtcatttgacagacaaggaaaccccagagccaagaaagttcctgctccaccccagaacagccctcttcttcgtcatgggtttggaacttcccttcccagccccgcccactctctgagtgatagacaccagcacacaccctctcccaaggaggggccagaacaagctaccattctctcagttctctagtgacctctcagctcagaaacagttaagaccgggccgggtgcagtggctcatgcctgtaatcccagcactttgggaggccgaggcaggtggatcacgaggtcaggagatcaagaccatcgtggccaacatggtcaaaccccatgtctactaaaaaatacaaaaaattagctgggcgtgatatcccacacctgaagtcccagctactcgggaggctgaggcagggggatcgctcgaacccgagaggcagaggttgcagtgagccaagaacatgccattgcactccagcctgggcaacaagagtgaaaccccatctcaaaaaaaaagacagccagccctcgacttctggcccccaactcgaggccacccctcccagccccctctctagccagggtggcctctctctggacccatggagaccgaggggtggctccaagctcccaggagggagaggctgtcctggggatcacgagaggacccaggcaccgcagctccgccacccttgtctggagcagaatcctgtgatcagaatggtaatctcgggttaccccacccaagtcaggatggcctgggagtacagataagggaagaggaagccattagcaggctgatgctataatacttctgagcacagtccctgttcacttccttctttgtttcatctcctgtcttttcattgaacttcaagattaggaggggaaagagacagacaaaggagactgataactaaccccaaaaaagaactagggaaggggccaggcatggcggctcacgcctgtaatcccagcactttgggaggccaaggcgggcggatcacgaggtcaggagatcgagaccatcctggctaacatggtgaaaccccatctctactaaaaaatacaaaaaattagctggatgtggtggcggacgcctgtagtcccagctactcgggaggctgaggcagaagaatggcatgaacccgggaggcggagcttgcagtgagtcaaaatggcgccactgcactccagcctgggcaacagagggagactctgtctcaaaaaataaataaataaaataactagggaaggaagggaaccacttagagtagttgaaccacttccagtacttactatataactaaggaagtacaggttgaatatccctcatttccaaaatccaaaatgctccacaatctaaaacattttgagcaccaagatgacactcaaaggaatgctcactggagcatttctgatttcggattttcagattagggacgctcaaccagtaagtataatatacatagccccaaatccgaaaaaatccaaaatccatgtgcttctgccactgtagatgtctgcccccatggctatcgtgactatatgctcgagtaggagagtaaagtgttttcttgggggtggaagggagttggggtgggtaaaagaaaagggagggaaggaaattgtcaaaatggtcccattttggataagagacactcaacctatagtaactaaggcacatctgatccttgcaacagtgctgtgaggtattcttaccctcatcccactctatagatgagataactgaaattcagaaaaaaagagatctagggtcccacagcaggcaaacagcagagatgagtttaagcatagatctcacacctgatttaaaattcagcctctttgcttttatatcaggcaggagtagaagcccctgaggcatctgtagcacgcacctgcgtgaataggcagcaccagggtggggccaaggcagtaaagatcaaaacgatagatagaaaggagctgagcaagctgttgttgctaccattatttctttcccctgcggaaagttgatctgaagcctgggtcctgggctaggaggtggggacctgaagttcttgtcctggctttgggactcactccactgtgagagccacatctctagacccagttttaacatcagtaagacaattcccctcaaatgaaagaatggccaggcgcggtggctcatgcctgtaatcccagcactttgggaggccgagccaggcggatcacttgaggtcaggtgttcgagaccagcctggccaacatggtgaaacctcgtctctactaaaaatacaaaaattagccgggcatggtggcacatgcctataatcccagcttctcgggaggctgaggcaggagaatcacttgaacccaggagatgtaggttgcagtgagccgagaccatgccactgcactccagcctgggcgacagaaaaaaaaaaaaaaaaaaaaactgaaagatcaaagtccactctgccagtttctgattctgaatgaacagcctaacaggaggcttcagggcagaatggcatggctccccaagaacctacaccagggggtcactactgatgtgcaactgtttccaaggacatcttcagaggcagaagtacatggcatgttctcagtatggggctgtccacaccctcccaaactgtccccataatgctgtctggaccctacggccagctcttcctgggtgatcagttacgcccgagctaaacagtatataacactctaggaaagaaagagtaggaggcaggaagtccactgacctgggttcatgaactagctgcaggaatccaggcaaatgacctcccctggcctccttttatccctaaatcagcccacgtgggggaaaggagtagggacttgtttatgggagccacagtggagaaacagaatcacctagccaggcatttcccagactgttctaaagaacacgccccaggagacgttaatgaatgagtgctggaaacagatgactcttgagaaacaatccacacccccttcttggaaattcacaatggcatattctgcccctgagaagtcctgcagtaagcaaccctgttcagctttgtttaacccagtgttccttcaaactcccttaagcctgagccacttttatcgaggcaaacctattaacaccctgtgggatgctgacccaggccacctttgtattacagacacccaaccctgagaatcattcatatcctaactcctcgtctcttataacctctgtgcgtacacccagctgcccctcagagcagtcacatgaagtactagacatgccctctcactctcagggggtcagcccagtgccaggatctctggcgagggtcctccccttcccccattccacacagctgctatcccaccgtgggatttactgccaagggccgggggacatatccagctaccacagaaccaggaaacgggcacccctaacctcacctctgtgcaacggggcaaagcacaaatcattacagacaaaagtgggagctcattaatatctcccttcccaccaatggaggtacctgccactgtagcctgtcgacttctggatatcatttctacttcaaaacaagacccaggttttggcctagaatcccagaatcttagggttggaagattctgtcaaggtcatcccttccactgtgtccccaacagaataggtccagaaggcccatgtcatgatcagacatgttgttagcagaacttcttcccagagaattgtatgagcttccactctctggtcgtcccagttcagccctctgaaaacacacaagtatgtgtgtttcccttctctgtggcttctgctttttctgaaaggcccagggtgaggcctgcggttggaggtgctctgaggtagacagcgtctggctgaggcacccattcccaggggaggaggctgagcccaggtggctattaccccagctcatgacatgaggctctcccaacacttacaggataacccatcattacctctctgaagggctcatttttacaagtgaggccttgaggtcatagcacagaaagacagggcccctgacactgtggtcctgcctcttccatttaagctataaactggttctctggatcctcatgactggagagacagagagaggaggcaggtgagaaggaagtatggctccccctttgcgccaataaagcagccccaggaggcacctggctcccctgccaccactggccagcccaaagtcgccagcttggaaaccaaagctcactaatgagatgaatatttcagagcccagagaactggacacctgagggcccttccatgacatctggctctgacctgcgttcccaggcctacttatcccatgtccagggtgctcaggtagaaccccaaactcctgggtaccacgtagaggccacagaggagggagaggagatggagaccccataggacaagaattggtgccgaccccacaaggccagggcctggcctcccagcagcctccctctgcttcctcccactggtccctggctcctgccccagtctctccacttgctttcccttttcccgtttctctgttttgttttcactctaacccaaagaagtcacgaggaggatgttactcccctgtagttctgtgaacccagccgggaaacagtggctggaagtgggactggcagagggcaaagtcatggtgatagaggtggccacttccccatgccaaacacttgagctgctcattggcttctgccccagctgcaagctaggacccccccttccccaccccttaaatattcacctgtctacaccgagactggcctcagcgcgtgtgggggcaacctggggtccgtgccaggccctggctgtctcccctccctcttccctcttctcaccagctgagggccatgaaagccctcatcccacacagctggccactcgggctggcatggtggataggccctgcgacagagaggccactcgtgcccgaaagagggaacacgaggacacccccagaccctggctccgctcaccagtgcccacaacacgctgctgggctcccaaggctaaccaggtgccacagacccggccgcccacccgcgcgcccagggagagcgaaacgccaagggccaggaggggagatccccatctggaacgggctccttgggcccaggagcgggcaagccgggagcgcgctccgaaaagtttaggcgccccggcgcatggccgccccagccctggaccagtccccaccgcccacagtccccaacggcgccggccccggccccctggcttgcctgcgccgttccagacggagcgttcctggcctcggagtgttgcaagtcctccggggccgggcagggctaggctcggctggggctccgcgccc

SEQ ID NO: 1171 - DNA, 127052 bp, Homo sapiens
gtttttttccccgcctcccaaccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggtaaggacgacccttttctcttcaaaccccatggtttcttttctccccggggtctggggcgggatgttaatccgctagctgttgtcttatgccttccagtatttcagtcctgaaggctcctttcacccccaacaaccctgtttctgtcagacttttcccagtttatcagtgccacgttctctggtccctgccagaaaaaaatgactgtaaattctggttctcaagagtggactgtgtgcagatgctgcctattctctaagctcagctggtgagttggcagtagtaatcatctggcctgtgtggcccccttaccttcaaagacacacaaatctggcgactgccaggtttggtgtggttattgtctcatttttattccgtgcacactgatcaatattaatttcgttatttaaagaacgaagccgcctctgactcctctacttatggtagtcatcatatattttttaagctgtgtgacttttaaaatctctatagggtgatgtattgaataactaaataatcagctatgactgcctttttgtgatcaaaatgttatgatagatgggccctcgagctatatgtgagacacacttgtgtcttggacatagttgatccatcattatctactcaatttgaattgttaatgaaatcagccaaaagattagaatctgaaaataaattttaagcagtggaatgtcatgtcagtgtcttcattgaaagaaaatagaatgaaattttgtatagctaagttgctattagggttggtgttttatgcagatggaaaactatacaaagttttaaatataaaaagtttaaaattgaactgtaatcatacttgctactaaataatccttgttttcattagctcattggtaactatattaatagtttatgacttagcaacttctgtaggtatagtagagttatgaaaatttctgggcaggatagtagatgcctttctatacacttctttggtaatcttcacatttttgtgtgtaaatgcccattataattacaagttttactttgcatatcaaaatcacttaagggtaagtcattatgaattaaactgtctgtgagcttctaactttcctgttgacagcctctacctggctttcttatttcatgaagattaaggccctcagctaagtgcttccctataaccccctcctcttcaccataacatagacatgctatgatagggtcaaggaatcagtacatttatatgtgcgctgcatgcttaactctaaagactgaaaaactctcgggcagagtaggtagaaatccatgaaagtttggagtattaaagtaaggtcttcctacttggcatggttgagcattacaattcacattcttctctctggtctcaaaggaaagtctcttgttgtaattaatactcttgattccattctttcatccattggactttttgttgttgtcgttgttgttgttgttgttgttttttgagacggagttttgtttttgttgcccaggcaggagtgcaatggcgtgatctcagctcactgcaacctccgcccccccggggttcaagcaattctcctgcttcagcctcctgagtagctgggattacaggcatgcaccaccacgcctggctaattttgtatttttagtagagaaggggtttctcaatgttggtcaggctggtcttgaactaccaacctcaggtgatccgcccgcctcagcctcccaaagtgctgggattacaggtgtgagccaccatgcccagcctctttttttttttttttttttaaagagacagggtctcattgtgttgcccaggctggagtgcagtagctgttacacaggcatgatgcactatagcattgaaatcctgagctcaagtgatcctcctgcttcagcctctgagtagctgggactgcaggtgtgcaccaccttgcccagctctactgaactgtctctttcagtttgtttcactttttaccttcaacagtatgtgggtgtcccctgttctcagtaaaggaaaaaaaatctgtatattcctttctcccaaccaacccatttgttttttcactttcattgctaaagtcaaattattgatggtctacaaatgttccatctacctattttttcataaccatcctaatcttaaaatgtctgccatctttctttcctccccttttttgaaactattctcttgaaggtcacaaatggcagtcttcctagtcaaaaccaaagaatatttttattcttactgtatttgacctcccagtagtttgatcctgttgattgtctctagctatttggaaactattttctttcttgcttctgttatactggactctccagtcttatcttcttcactatattctttgctggatttattttttctttccagtcacctagtaagggactctgttattgagcctttgctctcccataagagcagtattccccaaagtagtgttaaacagaatacccttcttgtaatatttcttaggtggtgaggagaaaaaaatgaaaaccttttttggagggaaatgttagtgtatcctcctcttggaattcataatgcctgctggaatataaaagctctgagaaatccattaataaagaaggctattcaattttgtttaactcagtcttgtttagtttatttgatcacaggttactattttcatggcctacctattatggcacagaataatatagcaaagcccactagtttgggaaatattgccctgggtatcttaactacttttaagtgtttggctaatattttatgcagctggctcacaagactgtatctcttattgaatgtcagttctgtgtgtgtatatgtgtatacatacatatatatatatatatatttttttttttttttagacagagtctcgctcggttaagcaggctggagtacagtggtgtgatctcggctcactgcaagctccgcctcctgggttcacgccattctctgcttcagcctcctgagtagctgggactacaggcgcccacctccatgcccggctaattttttgtatttttagtagagatggggtttcaccatgttagccaagatggtctcgatctcctgacctcgtgatccaccagccttggcctcccaaagtgctgagattacaggcgtgagccaccgcacccggctagttctgtatatttttaaaagttttttctttttttagttttgtagagatagggtgttgctatgttgcccaggctgctttcaaactcctggctccaagtgatcttgccttgggctcacaaagtgctgggattctaggtgtgtgccacagcacttggtgtgccacttctgtattttgagctggctataacaactttcttgggctgcttgtgaatgtctgttcttggggttaatgaggactctctgagctgcttagtagaaagggtagtcttggtctctgtattttaaacttaacagtttttcagggttttttttattgttattgttgtttgtttgttttgagacagggtcttgctctgtcacccaggctggagagcagtggtgcgatcatagtttactacagcctcaaactcctgggctcaagcgatcctcccacctcggcctcccaagtagctgggactataggtgcatgccaccatgatggtctaattttttattttttggtagagatgagggtcttattatcttgtccaggctggtctccagttcctggcctgaagtgatcctcctgccttggccttctaaagtgctgggtgtgagccaccatacttggccacttaacagttttagatctggaaaattattggaaaattagatctggaaaactaaacaagtgatcctcctgccttggccttctaaagtgccaggtgtgagctaccatacctggccacttaacagttttagatctggaaaattattgcaaagatagtacagggagtttttatataccccacacccagtcttccctattattaacatcttaacataagtatgatgcatttgtcacaattaatgaaccagtattgatatcttattatgaaagtccgtactttattcagatttcttcagttttcgcctgctgtccttttttaattccaggatctcatccagagttacgttacatttagacattatgtcttctgaagcttcttttcagcctttccttgttttttagaccttttcttgtttttgataatcttgacaattttaaggattactgattaggtgttttatatagaatgtccctcaattgggaattgtctgagtcttttctcaggattagactggagttgtgggttttcggacaaagaccacagaagtaaagtaccaatctcaacacatcataacatgggtatgtttttcaaaatgatttatcactacttatgttaacctctatcacctggcgtgagatagtgcttgtcaggtttctccactataatgtactcttaaaaaaaatctgtttccatactgtacactttggaagaaagtatgttcaccctcacttaatgagtgggtagttatgtttttcctccttaaggacagagtatcaacataaactatatggaattcttctgcaaaggagatttgtctcttctccctcatttattaacttaataatttacttgtatcggtatggactcatggatatttattttgtactttggcttataatccaatattagtttatttttttgttgctcaaattgttctggctctggctgttggagagctccttcattaactcctgtatccccttcttacttttatagtgccagaaagtacagagaatttccacataccctacacccagtttcattgtgacatacccctttcttactttttggtacttttagatgctctaggcctatctatacgtttcctactccagccctagagtcaaccatttctccaaggaaccttggttccttttattggagaatggcattagaaaccaaggtctgcagctgggcacggtggctcacgcctgtagtcccaacactttgggaggctgaggctagtggatttcttgaggtcaggagttcaagaccaccctgactaacatggtgaaaccccatctctacttaaaaatacaaaaattgggccagacacggtggctcacgcctgtaatcccagcactttgggaggccgaggtgggcagatcacaaggtcaggagttcgagaccagcctggctagcatggtgaaactccgtctctactaaaaatacaaaaaattagtcgggtatggtggtgcgcacctgtagtcccagctacttgggaggctgaggcaggagaattgcttgaacccggcaggcagaggttgcagtgagctgagatcacgccattgcactccagcctggaggacagcgagactccatctcaaaaaaaaaaaaaaaaacaccaccaccacaaaaaaaaacaaaaattaaccgggcatggtggggggcgcctgtaatcccagctacttgggaggagtatcgtttgaactgggaagcagaggttgcagtgagccaagattgtgccactgcactccagcctgggcaacagagtaagactctgtctcacaaaaaaaaaaaaagaaaccaaggtctgcttggcagatatgctcgttgctactataaggttatctttggaaatcaaggaatcctttctccagaggaatcagaaaggtgatatttggtttctttcacattattatgccattctgtcacttccagtctgttacctgggttactaaacacataaattcctttttttttttttttctgagatggagcctcactctgtcacccaggctggagcgcagtggcgcagtctcagctcacttcaacctccacccgccgggctgaagtgattctcctgcctcatcctcctgagtagctgagactacaggtgcatgccaccatgcctggctaatttttgattttttagtagagacagggtttcaccatgttggccaggctggtctttaactcctgacctcaagtgatctgcccaccttggcctcccaaagtgctggattacaggcatgacccaccacatccggccttgaacatggaaattctttaagggagctttaagttgctcctgtcttgtccaaagaagtgagaaacaacccccacttctctgagattccctcaaactttctgattttttaaacttccctctaaagggtttcagcctggaggggtgtattagtttgctagggctgccataacaaaatgccacagactaggtggcttaaacagcagaaatttattttctcacatttttgaaggttggaagtctaagaccaaggtgccagcagggttgtttttctctgaacttctctccttggcttgcagatggcaaccttcttgctgctttattgtgacatgatagtccctctgtatgcacacatccttggtgtcttttcctcttcttaaaaggatacgagtcatattggattagacccactgtaacttaagcactttaaagaccttgtctccaaatacagttacattctgagatcctggaggctgggacttcaacatgtgaatttgggggaaacacagttcatcttagaacaagggagatccaccacacatacacacacacacacacacacacacacacacagacacccttttatttcctcttttatcagaaaagtccttatttctctttcctcagtacagggcatgtctcttaactttgattattattctctctctctttgtcttttaaagagatggggtcttactacattgcccaggctagaatgcagtagctattcataggtgtgatcatagcacaccacagccaggaactcctggtctcaagtgaaggtcctcctgtttaagccttctgagtagctgaaactacaggtgtgcaccactgtgcttggctcctaaacttggattcttgcaaactgtagctcatactaaagctatgtggtccagctgtggcacgtcaagctcttgataaataaaaggagctgttagaatgtagaaaaagtcctcaaaattgtcgttttattacacacatacacacacatacacacacatcagttttgaggtttgaagctgaatagtaaatgaccttttttccctttaacaaccataattttccttgaggcagcctatgcctttagttgaatggggaaaaggtcatatgtcagaaaggaggatgagaagcgtattacaaaaaaatgctttttgggggaaaattttggaatataatagtagtctctcttattcttgagaggtttgagtaaattgattaaaattcttaaaacagtgcctactacattgttattctacagctacttccttatttcttttctgccttttttccaggatgggactctgtctgtgttcctgcccaagatctggtcccagccctagcctacctgcctcaccctttgctcctgaatgtctgactgtttttgttatttgcttgttttcagtttcctggttcatttccagttaggcttagttggctcctcccataggtgtcttagctgactccctagagcttgcctgttcttctgtaatttgagtatcaaccttctacagttctaatatgctgcacatgataattcctgcctttgcctctgcctcaccagccataatctggccaacttttaactgtaatttctacctcaaattattcataaaccaatcaaaactgataactcttccaaacgatatccctttcctaccttcttggttcctataaatgatgcccatgcaactgttatttaagactgaggttagaaatttggtgttgtctttgattccttcagtgtatcatattgagtgcttcaacatgcagaggagttacttgatcgaattaaaaaaaacgtcattctgactgcagaatagagaacttggcagatccctaactagtcccctttccttggtctccatttctttttgtcagttctcctgtgaagccagcctgaacttcctcaaaccttattttcagagtggctgtatgactcactgactacatcaggttagaattctgctgtctcatctttaaggtcttccatagaatggctctagctacctttgtctcccactatctcctgacccaaattgtatttcaggctgattgttttgcttacttttgccttcccacctgcctttctgtgtcatgttaattcctgtttctgtgcctttgttcctgctgtttgactcttagtttcttgcctcttttctgtatatttattataccaatttttttttgtttttttttttttaattgaggcagagtcttgctctgtcgcccaggctggagtgcagtggtgtgatcttggctcactgcaagctccgcctcccgggttcacaccattctcctgcctcagcctcctgagtagctaggactacaggcacccgccaccaggcccagctaaattttttgtattttgagtagagaaggggtttcaccatgttagtcaggatggtctccatcttgatctcctgacctcatgatccacccgccttggcctcccaaagtgttgggattacaggtgtgagccaccgcacctggccttttttttttttttttttgagatggagtcttgctctgttgcccaggctgcagtacagtgacgcaatcttggctcattgcaacctccgcctcccgggtttaagcgactctcctgcctcagcctcctgagtagctgggattacaggcacgcaccaccaggcctggctaaatttttttgtatttttaatagagatggggtttcaccatgttggccaagctggtctcgaactcctgaccttgtgaaccgtccaccttgacctcccaaagtgctgggattacaggcatgagccaccacacctggcctattctaccaatcttttatccagcttctgatccatgtccactatgaagccccctgggacttctgacctggaatatgcttttccttcttttctttttctttttttttttttttgagatggagttttgctcttgtcgcccaggttggagtgcaatggcgcgatctcagcttactgcaacctccgcctcccaggttcaagtgattctctagcctcagcctcccaagtagctgggattataggcacccaccaccatggccggctaatttttttttttttttttgtatttttagtaaagatggggttttaccacattggccaggctggtctcgaactcctaacctcaggtgatccacccacctgggcctcccaaagtgctgggattacaggtgtgagccactgctcccagccatgcttttccttctttatacaccatttacatttattgtttgagcttcattaacttattttgttcattttttactaatagcttattgtttgtgaacttcgttttctcaacgaaattttaagttccttgaggaaggactatgttttaaattttttcctgcgggaaaaattgttcttagtgctgttacaaaatgtacgaggttgatttgtatcccctaaaaggatatattgaagtctaaatcacctgtgaatgttatcttagtttgggaatagggtctttgcagatgtaatcaagttaaaatgaggtcatactggattagggtggcccctattccattataactggtatccttataagaaaaaaaaatagaattagggagaacaccaggtgcatgaatacacagagacacacagacacattgcagagaccgcatggcagataaaggcagagattggagttatgtttccacaaaccaaggaatgcccagggctaccagaagccagaagccaggagcctccccctagaggctccagtgggaacagggctttgccaacaccttgattttggacttctagcctctgaaaccatcctctagcactgtgagacaatacatttctgctttatgctattcagtttgtggcactttgttatatcagcctaggaaacaaatacacaaatgcatacttaaaagttaatttgattttttgactagataattgtttttgttttttttttttgagacagagtctcgctctgtcgcccaggctggagtgcagtggcgcgatctcagctcactgcaacctccacctcccgagttcaagtggttctcctgcttcttccttccgagtagctgggattacaggcacgcaccaccacacccagctaaattttgcatttttgatagagacagtgtttcaccatattggccaggctggtcttgaactcctgacctcaggtgatccgcccgcctcggcctcccaaattgactagataactactcttatataatatatactgtgtggcagtatggttcactggaaagaacaagggtttttggagtcaaacagacttgagtttataattctaccattatgttacctctccttaagcctgtttcttcactcataaaatgaagaggattcatgaagtaaaatatttagaggcctgtcccatacaaagcttgacatttaataatattggttcctttctttcatgggtgcattggtatagctaatcttgaagaaatttggggctaggtgtagtggctcatgcctataatcccagcactttgggtggctgaggcaggaggatcatgtgaggccaggaggttgaggctagcctgggcaacatagcaaaaaaaaaaaaaaaaaaaaaaaaaaagctgggcatggtgacacatgcccatagtcttaattgcttgggaggtttaagctggaggatcacttgagcccaggagtttgaagctgcagggagctatgattgtgccactgtgccctagcctgacaacagagcaagaccctgtctcaaaaaaagaaagaaaaggaaaaaagaaaagaagagaggagaggaggggaggggaggaggaaagagaaggaaggaaggaagggagggaaggaaggagggaaggagagaaagaggaagaaagagggagagggagagggaagaaagaaaagaaaggaagaagggagggaggaaggaaggaagaagtttagtcttgtattattctattgaaacccaagtatattaattcagttgacaaaaatttattaaatatattgggcacttactgtgctatacactaaaatgatctttgaaacaagttttcacttttctttgtctccctttcttatttttgtatttctctgttttttcttactctcctgataaaggactgagtaatctcaggaggttccatgaagatcataaaacaagctgctttttgaaaaatgatgactaggatttagttgtgcagaaaaaaggtaaaaggacattcaaggagctcccttttacttactccatagaggcaaacaaacagttcttatagtgtggcatgtaacatctgtctcctgaagtgacagggagtaccttttgacttatgacctcattaaacaggaggaactagtccttacaatttttggttgaagaccttaaagttccccatgttagcctcttcctcaaaagagagttaaagtttccttgaattcaaagtccaggcttttttctagggacagactgggcatgcagtaatttcagtttctcacagtgcttcaaggctctctttcttgttcttaattaactttatctaattttcttacactgtttctggccaggtagttcctcttttgaacaatgttgccacagagcttttgctcagatgcttttaatgtctgattctttctcttttccaaactacactttttccctgaggatgacttcaaaacttacatccacgaagctttttctatttaatataaaatgatttgctttccttttacaatttcaattttctatatccaatttaagttcaacttaggggaacattttttctcatttgatgattaacaaaggcctctcatagctcactgcagcctcagactcctggcctcaagtgatcctcccgcctcagcatctcaaagtgctgggattacaggcatgagccaccatgcctggctacattttcactcttaaacttgactctctatagcattttatactgatgatctctcctttctctcctttttgaaacttcttccctttagctttaataatacccatttatcttggttatcctatcattttcccactcaatgtttacatatgctgtgcttccatctttaaccccattttaatttctttattgaacaaatatgttcaagtttctattttggatcagttactatgctgcatgcatatcacatagtgaatgagtgaacaagacagatatggtatacattgactatggaacttacccttgagcaggggctatgaggggaagacctaacctattttagaggcttagggatgacattcttgagagttttagttgagtcctaaaaaaaagatcaggatttaatgaggcaaagattgagtgagaggtttgagataagaggctcaggagagatgaaaagagggttccagatgtagaatgttgcatattttattttattgcatattttaaagcacaggatatcagccgggtatggtgccacatgcctataatcccatttactcgggaggttgaggcaggagaattacttgaatccaggaggcagaggttgcagtgagccaagatcatgccaagtgcactccatcctgggctacagagggagaccctctctcaaaaaaaaaaaaaaacttaggagccaaggtcatggcaccactgtactccaggctgggcaacagagtgagatcctatctcaaaaaaaaaagttcaccatgtggaatgagggagctagaatgagtgtgataatatttgatgttgcactacaagactggattcagattgtgaaaagatttgtgagtcatgttaagggcaataggaagccattgattgactctcttttttacatttaattttttttttttttttgagatggagtcttactctgttgcccaggctggagtgcagtgtcacgatcttggctcactgcaacctctgtctcatgggttcaagcgattctcctgcctcagcctcccaagtagctgggactacatgcacatgccaccacacccagctaatttttgtatttttagtaaagacagggttttgccatgttgacgaggctggtctcaaactcctggcctcaagtgatctgttcacctcggcctcccaaagtgctgggattataggcatgagccaccacgcctagtggttctagtttttttcttgtcttccaatgatatattgtgaattttctttctttcctattttttttgagatggggtctcactctgttgcccaggctatagtgcagtgtcaccatctcagctcactgcaacctccacctcctagattcaatcgagcttcctgcctcagcctcccaggtagctgggactacaggtgcacagtaccacacccagctaatttttattttttttgtagagatggggtttcattgtgttgcccaggctggtcttgaactccaggacttaagtgatctgccggccttggcctcccaaagtgttgggattacaagcatgagccaccatatccagcctgtgaatttcttgactataaaaatatagtctaggctgggcgcagtggcttacacctgtaatcccagcgctttaggaagctgaggtgggcgtatcacgaggtccagaggtcaacaccatcctggccaacatggtgaaaccccgtctctactaaaaatacaaaaattagccgggcgtagtggcggacgcctgtagtcccagctacttgggaggctgaggcaggagaatcaattgaacctgggaggcagaggttgcagtgagtggagatcgcgccactgcactctagcctgggcgacagagcaatactccatctcaataaataaataaataaataaataaataaataaataaatagtctaaatctagtataaatctaacacttaatatttcatactattccctatgtctggactcagtaaatatttgatgattgatttagcaatttgtattgcttcttgaaccaacgggtgcataaatatgtactagggctaccacagatattatccacatatctgattgcactaccttttctggaagacataactaaaatattcagatgtaaaactactgcttgtcaactcatctttctagtatacatagaatatatcttttatttgaaacgtgttatagtagatctagaataatattttattcatttagaaactcaaaaatatttttctgattcaatttagtgtttaagtgaagagaacaaaaccttgggattagcttcatggggatataatgaaaaaaagtttgagttataagcatagcttggatttttgtttgttttttttggtgacagggtctcattctgtcacccaggctaaactgcagtggcatgatcatggctcactgcagccttgaccttctggactcaagcaatcctcctgcctcagcatctggagcagctaggactacaaacttgtgccatcacacctggctaattttttttttttttttttttttgagacagagtctcgccctgtcaccaggctggagtgcagtggtgtgatctcagctcaacgcaacttccacctcccaggttcaagcaattctcgtgccttagcctcctgagtagctgggattacagacatgcaccaccaggcctggctgatttttgtatttcagtagagacagggttttgttggccaagtaggtctcaaactcctgaccttaagtgatccgcctgactcggccttccaaagtgctaggattacaggtgtgaaccacggtgcctggccacacctggctaattttaaaattttgtagagatgtggtcttgctatgttccccagggctggtcttgaactcctggcctcaagtaatcctcccacctcaacctcccaaagtcctgggattacaggcataaaccaccatgcctggcctattcaagttttatcatgagattgcagtaattcagtcacgtcttcaggctccacttctttttttttttttttttttttttttttttgagacagagtttcactcttgtgtcaaggctggagtgcaatggcatgatctcggctcactgcagcctccgcctcacaggttcaagcaattctcttgtctcagcctcctgagtagctgggattacaggcgcccaccaccacacctggctaatttttgtacttttagtagagacagggtttcaccaggttggccaggctggtctcaaactcctgacctcaagtgatctgccctcctcagcctcccaaagtgctgggactacaggcataagccatcgctcccagccctccaggctctacttctatttctagttctctctctttctctcttactcagtcacttaggctgaatgcagtggtgcaatcacagctcactgtagcctcaacctcctggggtcaagcaattctcccacctcagcctcctgagtagctgggccacaggcctgagccatcactcctggctaatttttaaaaaatggtttgtagaccagggtcttgctatgttgcccaggctggtttcaaactcccatactcaagtgatcctcctgccctggcttcccaaagtactgggattacaggcataagccaccgtgcctagcctaattctaggtctcttgctatttgtaccacatctgcagttacttcctccactgaagtcttgaatcccctcaaaatcattcatgagagttggaatcaacttattccaaactcatgttcctgttaatattttagccttcttctatgaatcacaaatgttcttttttttgaggcacagtctctgttgcccaggctggagtacagtggcacaattcatggctcactgcagccttgacctccctggactcaggtgatcctcctatctcagccttccgagtagctgggactacaggcacatgccaccatacctggctaattttgtattttttgtagaggtggagttttgccatgttatccaggctggtctcaaaatcctaggcccaagcaatttgcctgccttggcctcccaaagtgatggaattaatggccactgtgcccagccacaaattattataattttttttttgagacagagtcttgatctgtcacttaggctggagtgcagtggtgcgatctcggctcactacaacctctaccccctgagctcaagtgatcctcccacttcagcctccgagtagctgggaccacaggtatgggcctctacacctggctaatttttctatttttagtagagacagggtctccccatgttgcccaggcccgtcttgaactcctgagcccaagtgtccacccgcctctgtctctcaaagtgctgagattatagacgtgagccactgcacccagcctctacaaatgttcttaatggcatctagattggtgaattctttctagaagactttcaatttattttgcccagatccatcagaggaattacatcatggtaggtatagccttatgaaaggtatttgttaaataataagatttgaaagtagaaattactccttgctccatgggttgctgttagcagacatgaaaagattaatgtccttgtaaatcttcatcagagatcttgggtgaccagggacattgtcagtgagcactagtattttgaaaggaatcttttttttaagtagtatatctcaacagtgaactgaaaatattcagtaaaccatgctgtaaacagatgtgctatcatacaggctttgttgttccatttatagagcgcagataaaacagatttagcacaattcttaaaagctaggattttaggaatggtaagtgagcgttggcttccacttaaagtcaccagctgtccctaacaggagaatcagcctgtcctttgaagctttgaaaccagatattgacttctctgcagctatgaaagttctagatggcatcttcttccaatagaaggctgtttcatttacatggaaaatgtgttgtttagtgtagccaccttcagtgatcttagctagattttctggataacttgctgcagctttttcatcagcacttgccacttccccttgcacctttatgttatggagattgctttttttttttaaacttcatgaaccaacctctgctggcttccgacttttcttgtacagcttctttacccttcacccttcatagaattgaagagagttaagtccttgctctggattaggctttggtttaagggaatattgtggttagtttgacctatctggaccatggaaactttctccatatcagcaacagtaaggctgttttgccttctcgttattcatgtgttcactaaagtaacactttgaatttccttaaagaatttttcctttgcattcacaatttggctgtttggcacaagaggcctagcttttggcctgtctatgttcttgacgtgcccttttcactaagcttaattatgtttagcttttgatttaaagtgagagacatacaactcttttacttgaacacttagaggtcattgtagtatcgttttgtctcaggaaatagggaagcctgaggagaggaagagagatgggggaatggttattccatggtaactcccgttatcgtctccccaacccttggcaacctctattctactttctgtttctataaagttgtttattctatttacacacacaacatttattgattaaactcactgtcctctatgagtgcagtttgtggtgcccccaattataataatattgaaggtcacagatcacagatcaccatgacagatgtaataaagaaaattttgaaatattttgagaattatcaaaatgtgacatagggacatgaagtgagcacatgttattggaaaaattgtgccaatacatttgctcgatgcagggttataagaaacgcataaagcaaggtacaataagacaaggtatgcctgtatccaagttatactgcttatcatcagggacttgtctcataagctggaaactaacatgatactaattcttttttttttttttttttgagacagagtctggctctgtggcccaggctgaagtgcagtggtacgatctccgctcactgtaagctctgcctcccaggttcacgccattctcctgcctcagcctcccgaatagctgggactacaggagcctaccaccacgcctggctaattttctgtatttttagtagagatggggtttcacagtgttagccaggatggtctctatctcctgacctcgtgatccgcccaccttggcctcccaaagtactgggattacaggcgtgagccaccgtgttcagcccacatgatactaattctcaatgggcagaatgaaataaaaccatttattgatatagtgctttatgattgttcaaagtttattatatgcataagtcatttatttgggaaagttgaataccatgtggtatgtgatagggatagaaagatagtaagattcccgttctttgaagaagtgagggaggcacacatagaaaaataatccataatgcatgattaaatgctatagtaaagctgcttacaaaggggtttgagaatacagaggaataactgattaacttcctcaggaagtcaagagcgaaataattcactgaaaaggtgatctttagtaatttaacaaaatgagaaagggataaggacaggaggaacataaatgaggccaggaaagctggaaagtatgttgtaccttcacagaaggtcaagcagtagaataggagagtgtaatataaggtacatggtattgagaagtaggggaaattatgtctgagttaaagctatttggggccagaataatgatgattattgttattactattttattgtggtaaaacatctataacaaaatttactatttttaccattttaagtgtataatttagtggcattaagtacattcacaatgttgtgtaaccatgattactaccatctatttctagaactttttcacgatcccaaaccaaacaaaacctctacccattaagcagtaattcccattgcccttccctccagcctgtggtaacctctattctagtttctgtgtctatgaatttgtctattctagatacctcatataggaggattatacaatatttgtccttttttatctggcttatttcacctagcataatgttttcaagattcatttatgttgtagcatgtatcagaacttcattcctctttatggctgataatattttattatgtgtatataccatgttttgcttttcattcatctgttgatgaacacttgagttcttcccctctttcagttattgtgagtaatgcctctataaacggtggtgtacaagtatctgtttgagtccctggtttcacttcttttatgtctagcagtggaaatgctgggccatattctatatttaacttttttttttagagacaaggtctctttctgtcacctaggctgggtacagtggcatgactgtggctcactgcagctttgacccacctcaagcgattctcccacctcagactcctgaatagccgggactgcaggtgtgtgcaccaaaagcacaggcaacaaaactaaaaattgacaaatgggattacatcaaattgaaaagctcctgtacagcaaaagaaaactatcaacagagtcaaaaggtacctacagagtaggagaagatatttggaaatcatatatctgataagggttaatatccaaaatatataaggaacttatacaatgtaataacaatgaacaacctgttttaaaaatgggcaaaggactggaatagacatttcttgaaagaagacatacaagtggccaacaggtacagtcatatggaaaaatgttcaacattattaatcatcagggaaatgcaaatcaaaactacagtgagatactatctcacacctgctagaatgattattgtcagaaaggtgaaagataacaaatgttggtgaggatgtggagaaaggggaacccttgaacattgttggtgggaatgtaaatagccatatggaaaacagtatgtagtttcctcagaagttaaaaatagaactatattatgatctggcaatcccacttctgagcatatatttaaaggaaggctaccagggactaggggaaggggcaaatgggatgttggtcaaggggtacatagtttcagttatgcaagatgagtaagttctggagatcaatgtatataagcatatcaaatcatcaaattgtgtaccttaaatatatacaatctttaattgtcaaatatcccttaataaaaaagtaattgagaaaaaagtaaataaaataaaaaaattctatgagattcccaatttattgttttagctaaaaaggctaaaagctaaagacttttttttcttttgtgttgtttttaagccagtcaaatttagcagtgggactttgtagaaatagtaaagaagacattctactcctttacatagtaatagctaatgtttattaagcccttaccatgtgccagccagtgttgttaacactttatctctggcataaactttttgacaatgctatgagtcagataatattttctcattttatagataaaagaactgaaacagagaaggtaaacagtatgtccaaggaaatagagctaacaagtagtgaattcagaattcagactcaggcaatctaattttagaggccccaccccctcaccagcttttggttttttttttgatacggagtttcactctgttgcccaggctggagtgcagtggcatgatcttggctcactgcaacctccgcctcctgggttcaagtgattctcatgcctcagcctcctgagtagctggaactacaggcaaatgccaccatgcctggctaatttttgtattttttgtagagactgggttttgcaatgttggccaagctggtctgaaactcctgacctcaagcgatctgcttgccgtggcctcccaaagtactgggattacgggcgtgagctgctgcacccagccagagccccttcttttaagcactatgctattgggtttctgcatagtcacagtcttaatttactttgtgcagcattaattacatgatgcaagtttaagaattatccagagaagagcaattaaaatcaccaagggatgaaagggtactcacaagagaaccaactaaaaagacttggaaaggctgggaggccaaggcgggaatctctctgagattaggagttcgagaccagcttgggcaacatagtgagagtctctctttctctctctctctctctatatatatatatatgtatatatatatatatatatacacacacacacccacacacacacacacacacacacatacatattcagatagccaggtgtggtgatgcacacctataatcccagctacctgagagattgaggtaggatcccaggagttgggatcaaactcctttgatcccaggaatttgaggctgcagtgagctatgattgtgccactgtactccagcctggatgacagtacaagaccctgtctcaatcaatcaatcagtcaattaaaaaatacataggccaggcacagtggctcacgcctgtaatcccagccctttgggaggccaaggcgggcggatcacgaggtcaggaatttgagaccagcctgaccaacgtggtgaaaccccatatctactaaaaatacaaaaattagctgggcatggtggcacacacctgtaatcccacttattcgggaggctgaggcaggagaatcgcttgaacccgggaggcggaggttgcagtgagccgagattgtgccacttcactccagcctgggcgacagagtgagacttcatttcaaacaacaacaacaacaaaacgaacaagcaaaaaacaaacatacatacatacctggaaaagttcttaaaagaacatatgactaaagaatatggatataaactttccataccaaatcctgcaaggtagttttatacttatacatgttctacttataaatgacccattcttatagattatgccactgccttgatgctacatgtggtatttcttaccttaactgaaaaagagaaaactattttagagcttagtggggaaagtttcttaacaggttttacttccctaaatggttcccctccctaagaggaaaaacatttttccccaaaaatgttggggaaatgcctccaattaaagaggcattccaggcaccataactttaatgtgaattaatggcatagtgcctgtatttttcaaatgaaattcaggacatgatgtctgaaaaagattgcttttctttttttttttattattgtggtaagtgtgtatgtggtaaaaaacacataccttcaaaggagtggggagagacagtccttcgaagggcctgggatgagaactagaaatatttgccaatgttaatgaactatcaaaagtcttgattattaattcattctaacataaacctaatataggattgcttttgtgtgtgtgtgtgtgtgatggagtctctccctgtcacccaggctggagtgcaatggcacgatcttggctcactgcaacctctgcctcccgggttcaagcgattctcctgcctcagcctcccaagtagctgggattacaggtgcccaccaccatgcctggctaatttttgtatttttagtatagatggggtttcaccatgttggccagagagatctcgaactcctgacctcaggtgatccacctgcctcggtctcccaaagtgctgggattacaggtttgagccaccatgccaagtcgttaacataggatttcaaatccttgaaatttaaagtttgtgaacttcaaacttgcatgttcttgggagaatgtaacaagaaagagattaaaaccgctgaataaaccataattgttctccaactttatctggacctctaatctattacctcttcctttctagcagccctatgtattctttactttcctccctatccagctgagattttgtttcaatttagtttcttgccattaccctctcttttacatgccaatttcaagcacagctgcagaaaatcatataaccagatttgcaggaatttatgatcagcaaactcaactgggttttcagtaacacgttacatattatatttctccaggcaacacaccctttccaacagctttcagatctttgccctccttaggcccatttaaactttttttctcctttctcaagcttagtaggtgatcttgtctcctgcttgaccaagaattggactgataaaactttaactaccaaatctgtaggaatacctacatctgtacccatctgtctttcctctttgttaaaataaaagaaggttcatccattctccagggccagcctctctacctgttctctggatccaatgtcttccatcttttcaaagactttgtagaattagtaatccagtcctcctcttatattcaccctctcagtctatgcttgctcctcagcatttaaaaaatagttgtctggcctggcgcggtggctcatgcctataatcccagcactttgggaggccaaagcaggcagatcacttgaggtcaggagttcgagaccagcctggccaacctggtgaaaccccgtctctactaaaaaatacaacaatggctgggtgcggtggctcacgcctgtaatcccagcactttgggaggccgaggcaggcggatcacgaggtcagcagatagagaccatcttggccaacatggtgaaaccccatctctactaaaatacaaaaaattagctgggcgtggtggcgtgctcctgtaatcccagctacttgggaggccgagacaggagaatcatttgaactcaggaggcggaggttgtagtgagctgagatcatgccattgcactccagcctgggcgacggagcaagactccatctcaaaaaaaaaaaaatacaaaaattagcctggtgtggtggtgggcacctgtaatcccagctacttgggaggctgaggcaggagaattgcttgaacccagtaggtggaggctgcagtgagccaaaattgtgccactcactgcactccagcctgggctacagagtgaaactccatatcaaaaataaaaaatatttgtcttacttcccctttccaggaaaatttcttgaaaagacattttatctctgcattttctgctttcatctgcattttctcctcctactcctgataatctcagcatcttttccccagcattctatgttcttggcttcttatctctcagtttacttcttagtctcctttgctgacttcacctgtattcattattaaatgttatagttcatagttttgtgtctgtaatcttctcattctactctcttactacgtcatcatactcacttataaaacttgttacactttatgtgctaatgactccaaatctgtatcctttatccagacttctctcttgtttcttatatattgctgtatctttaggctttacacagtgtctttcacttagcaggtgttcaataaatgtttctttgtgactggctgactgactaaataagtaaactttatagtaattctttgtgattcttcttaacagaccaagatcaaatcctttgtatccctaggtctagcacatagtgggtactcactaagtgctttataaatgactgattgaataaataatgaataagcaccacaataaaataaaatttcttaataagatgaatgagtgaatgaaaaaaaactttgtgctgttcattatagccagtcaagaccaaagaccttgtttattctctttgaaaatgtaactgggggccaggcgcagtggctcatgcctgtaatcccaacactttgggaggtcgaggtgggcagatcacaaggtcaggagattgagaccatcttggctaacacagtgaaaccccgtctctactaaaaatacaaaaaattagccgggtgttgtggcgggcgcctgtagtcccagctacttgggaggctgaggcaggagaatggcatgaacccaggaggcggagcttgcagtgagctgagatcgcgccactgcactgcagcctgggcaacagagcaaaactccgtctcaaaaaaaaaaaaagaaaagaaaagaaaatgtaactgggtaggccgggtgcggtggctcacacctgtaatcccagcattttgggaggccaaggcaggtggatcacctgaggtcaggagttcgagaccatcctggccaacatggtgaaaccccatctctactaaaaatacagaaattagctgggcatggtggtgtatgcctgtaatcccaccaactcagtaggctgaggtgggagaattgcttgaacctgggaggcggaggttgcagtgagccaagatcgcaccactgcattccactctgggcaataagagtgaaactccatctcaaaaaaaaaaaaaaaatgtaactgataactggatataaattatactaaaacttggtttaagaagacagtaattcattaacagataagtaaaagttgcagatgtgattggaatgttgactgcatactctgtgtgaactatgagtagtgagaataaaaaatgttaatcacctaccaggtctagtatatacacagtagtcacagacacagactctggacggggtctatttgagaaagtattcaaaacctcctgtaggtatatgactgaggacacagtttcctcatttgtgaaatggggaaaaataactatgcccactttcatagggaggttgtgagaattaaatgagataatgcttgtaaagcacttagcctaggacctggcacaaaaataatcatttaatacccgcttgttattattaatgctattccattttgatccagctggtataggtgttaaccatgctatagatgaataattgccaaacctggctgcttatcagaatcacgtaagatttttaaaattaaaattcctgggcctttcccagactactgaatcagactggaagtagaatatgtcttttttaaagctccccaggtgattctgagcatcagccaggtttggcagttatgttacagaagatagacttgtctctagaaatcatctgagtatgaaatataatcaagaaaaatatttctggtgtggagaaaaaggagtcaagaatgacatctgtagtaagccaattgtatataacctttggaataaatggtcatagttgtgctgattgcccaagaacagaccgtaatgaaaggaaagcaggcacagctgagccattttcaaggttcccccaaatggaaagagaagcagagcaactgagctgttaagagctgccaaaattaatttagagaagccacgtaggatggggaaacatgaaaagaacttcagaagagagctggtagaaaaataaaaatgaagtttttgatattgcaggaagaaagattaagggaaaataaatgaagtagctggggatgaacaagaagtactatagggaagtatcaggaaaaaagaattcttgctgaggaaaacaaataaagagcataaacaaagaacataaaactcaggagagaggtctcaggaaggacagtaaacacattttaagagattcacagggaaaaggccaaacagagcaaggataattggcctattatagatggactcaaaatcccaaagaaacaagtattacaaaaagagagggataaggtaaagcctaaaggcaatgacggcgataacaaggggaaataaatgaaggcgctcaaaagaaaccttgaagaataattaaaattgtgcaaatatggataaagtataacttaaggtaggagagtgtgtagtacaaagagtatgggacataaaagtctaggggatcattgagcaaacatttattcagtgtttatgggtatcaggaagtttatgtgctgttacctgtgtggaatatatttagaaaaaaagtgaaaatattctggaagcatgatcagttcaacagagaatatgtgtggcaaaatgaagataatctctttttctagtcatgtaatagtaagaactccaattaatttctcaacagcagggacgttttggcagtcatttagaagataagcatattcctaatgaccacaaggaaattaaaactgtgaggagagagctgggtgtggtggcctgagcctgttgtcacagctactgagttcgagttcagcctgggcaacacagtgagactccatctctaaaaaaaatgaaaaaacagtgaactatgagaaggaatagttagaagggaagttaagctttcttttgaaggtgaggggatggtggtggagatattaaatgaaggctctcagaggaagggttaaagccaaaggagttaaagagctggcccggcgcggtggctcacgcctgtaatcccagcactttgggaggccgaggcagccaaatcacgaggtcaggagttccagaccagcctggccaacagggtgaaaccccgtctctactaaaaatacaaaaacttagctgggcgtggtggcaggcgcctgtaatcccagctgcccaggaggctgaggcaggagaatggcatgaacccgggaggtggaggttgcagtgagccgagattgtgccactgcactccaggctgggcaacagagtgagactctgtctcaaaaaaaaaaaaaacaaaaaagagctaaaagaccagactgggcaacatggcaaaaccctgtctgtaccaaaaatacaaaaatttagccaggagtggtcatctgtgcctgtggtcccagctactcgggaggctaaggtgggaggatcacatgggcttgggaggcagaggttacaatgaactgagattgtgctactacactccaccctgggtgacagagggacccaggctgaatatatatattcaactatagattgaatttccccacctccattagaatttttttccaatgtataagaatatgaaagagacagttcagggaagctgaagccactcacagcctaatatttaagaagagcatacctctaccaatttcagaagcagatttaaaatggagtacagagaacctggcatagcatcataaaaattgatttaaaaaagtgagacccccccatctctacaaaagacaaaaaaaattatctgggcgtggtagcacatgcctgtggtcccagctacttgggaggctgaggtgggaggatcttttgggcctgagaaatcaaggttgcagtgagctgtggtcatgccactgcactctagcctgggcagtagggcaagaccctgtctcaaaaaaagtgtttttttaaataaaaaaccaaagtgttgaaaatgaatacaaaggaagatgatgttcttggaagggcaacaagtacaaaaagagattaggttctgcaaatgaaggaattgggaaacaaagtaaaatacaggctaattggaagttattacggagcagttctgagtgagcaaactgatcaaatactgtagttgttggtgtcaggttttttttgcttcccctgtagctttccctcagtgatctcattcctatgacctggattaccatttgaatgtgaatggctctctggtcgtcgcccgagctccatatgtccaactgcctactgaagatctcttcttggatatgtcacagatgcctcaaaatcaataggtcaaaatctcaaaaaatcatttccccaattctctccctgaccccaagtctgttcctcttcctgtgtttccctattacagaaaattatattcttactcatctagtcaccccgattagaaatctaagcatcatacttgatgtttctccttttacgcctgtatataatcaattccacaagactattcttcccctttaatatctcacatgtatttacctctcttttctgattctattagtttagaccagaaattgaaaagaccttttctgtaaaagtccagatagtaaatactttaggctttgcaggccatatagtctctgccacaaccactgtagctcaaaagcagccacatacaatatgtaaacaaattagtgtggctattttcccataaaactttatttgtagacactgaagtttcattttcatgtaattcatatatcataaaatcttcttttgattttttccttcagctatttaaaaaaaaatgtaacagtcatccttagcttccttccctacaaaaacaggctcacaggccatagtttgcccacctctgacttagaccaacattctcacctatgatatggcagtagtacttggtctccctccttctcatcttgcccactctggtctactcttcatgttgcagccagattgactttttaaaattgcaaattgggactgggtgtgcgtggcttacgcccataatcccagcactttgggaggccgaggtgggtggatcgcctgaagtcaggagtttgagaccagcctgatcaatgtggtgaaaccctgtctctactaaaaatacaaaaattagctgtgtgtggtggtatgtgcctgtagtccaagctacttgggaggctaaggcaggagaacgacttgaacctgggacgtggaggttgcagcgagcagagattgggtcgctgcactccagcctgggcaacagaccgacactctgtctcaaaaaaaaaaaaaaaaaattggaagttgaattttactaccttgttaaaagaactttaaagattgaccatagcttacaggatgaatccatgtttcttggaagacccttcataattgtgaaccttacttacctttctagccatatttcttaccagttctccctaattctctgttgcagctactgggaattgtttataattcctagaatgttaagtgtttttcatatctaagttttgacacgtgccttgaatgcctttcttccttatcttctccctacttatacctggttcctgcaggactcatatcagtcatcatcatcatctccagaagccttctctcactccatgaaggctgtattaaatccttctattaagttcgcccatcatgtctgtagaaccgaatgatagcatttattttacggtattatgattgcctatttacttgactcccctcctaaatagtaagctccttgagtacatagtgtttgtctgttgtgttatcctcagtttccatttttctttttttgagatggggtcttgctccgttgcccagactgaagtgcagtggcttgattatggctcattgcactcctgacttctgggctcaagtgatcttcccacctcagcctcccaagtagctgggactataggcatatgccaccatgctcgactaatctgtttatttatttattttttattagagatgagatctcactgtgtttccaggctggtcttgaattcctgagtttgaatgatcctcctgcctcagcctccaaaatgctgggattataggcatgagccaccacgcctggccttccagtttcctgtatgataccccatagtaatgtgtgagtggggtttttgtttgtttggttggttttgttttcatttttgtttttgagacagggtctcgctctgccacctagggtaggagtgccgtggtgcagtcacagctcactgcaacctcaacctttagggctcaatcagtcctcccacctcagcctctcaagtatccgggcctataggcatgcaccactgtgcctggctaagtttttgtattttttgtagagaggggattttgccatgttgcccagagtagtctcaaactcctggcctcaggtgatctgcctgcctcagcctcccaaagtgttgggattacaggcgtgagccactgcacctggccatttttgtttgttttacattttaaaaattgacgtataattcatgtaccataaaatttatcctgttcaagtgtacaatttagtgcattttactatatctaaaatgttgagcaactatcaccatggtctaattccagaacgttttcatcacccccaaaagaaaccttgtgctcaacaaaaagtcactcctcattccttcctgcccccagcccctggcagccactaatctactttctttctttatggctttacctattctgtacatttcatatcaatgctatcagataatatttgaacttttgtgactgtcttttttcatttagcatatgtaatgttttccaagctcatccatattttatcatgttctagtactttattccttttttcttactgaatatcaacattatatttcattatttatttattttttgagatagggtcttgctctgtctcccaggctggagtacactggtgcaatcctagctcactgcagcctcaaactcctgggctcaagtgatcctcctacctcagtcacctaagtagctaggactacagacatgttccaccatgcctggctaatttcattttttattttctttagtttttgtaggtctcactgtgttggccaggctggtcttgaactgctggcctcaagtgatcctcttgctttggccttccaaactactgggattctaggcataaaccactgtgtccgacctagctgtatattttaaacttcattcttcaaagcacccaggactcgggggggtgaaaaagagggaccccctagactccttctcttgcttcacctagaacatttatattttcatctatttatggacaaacttttattttaaatttgaaagtcgtgggctctcagattgaagaatacactctacctgggactgaaagatactccatggtctttttactccatctttctttccaactcttcttttcatgtgctccagtcagacagtatgttggtggagtcttgaggtatacctcatgctttcttgccactgtatcttttcttataccatctcctccatctgaaatgcccctttcccatctgtttaaatttttacctaactttcaatgcctaatacagatataatcaattccatgaagttttcccggatctctggattcttgtagtaattatactgctttagatggtgccttgtctaatttcttgagactactctcatgttttcttagttgttttatactttcccattgagtggctggacatgggatggtgggggactgggggttgggggtgactataacagattgcatgggccaggcattgtgcctcactcctgtaatcccagcactttgggagaccaaggcaagaggattgcttaagcccgggagttcaagaacagcctggacaacatagcaagacctcatctctactaaaaataaaaaaattaacctggcatggtggcaaatgcctgtagtcccagctatcaggaggctgaggtggaaggatcgcttgagccctgcagatggagactgcagggagctgttttgccactgcactccagcctggtctgcagagtgagaacatgtctcaaaaaaaaaaaaaaaaagggggggtggggggatagcatgagggagatctttgtgatgataaaagtattctgcatcttgattgtgatggtagttatacaaatctgcacatattttaaaatgacatagagctatacattcatattgtaccaatgtcagtttcctggttttgatgttgtactgtagttacataagatgcacccattgtgggaaattatgtgaattgtgtgaaggttacctgggacctctctttgctatctttgcaatttcctgtgaatctgtaattaattttaaaataaaaagtttaggttggccatggtggttcatgcatgtagtcccagcactttgggaggccagcaggagaatcacttgagtccaagagttcaagaccagcctgggcaacatagcaagaccccgtctctgcaaaaaaatatatttttaaaaattaactgggtattatgatacatacctgtagtctcagctacttgagagcctgagataggaggatagacttgggccctggaggtcaaggctgcagtgaaccgtgattgcatcactgtactccagcctggttgacaaagcaagactctgaaaaaaaaaagtttaaaaatatattcttcaggccaggcgtggtggctcatgcctgtaatcccagcactttgggaggcagaggccggcagaccacttgaagtcaggagttcgagaccagcctggccaacatggtaaaaccccatctctactaaaaatacaaagattagctgggtgtggtggtgcgcacctgcagtcccagctacttgggggctgaggcagcagaatatcttgaacctgggaggtggaggttgcagtgagctgagatcgcaccactgcaccgcagcctgggcgacagagtgagactcagtataaaaaaacaaatcatttttccatggtgctacttctgattaatgtgaatctgcctgtgccttccaaagtaaagttactttggggtagacaagagatgtatttttagtgatattttagttacattttacaattagaacaaacttgtctaaagcaataactgagacagagtggttagttccctgtctacgaggtcctggcttatccaaggtcttattttaatttttaagttgactggtaagcctttgagtcatgttttcgtatacttttaagttcttagtattcttatgtactggctcctagaagacagtgaccatagctctgagttttagaaaaaaatcattatgtgatgttcagttcaaactttaaaacttttaaagttgttacattgtttatcaattgaaatgaattttcttgtgcaaatttaaagtaagcattacaagatcagaattattgctgattttttttggaaagaggtagagtataaataaataaccagagttttttgtttgcatttatgatcaagctcaaagtgaatatgaaccaaaaaaatgaacaaaactacatattttttagtaaaatgagaacttaattttttttcaggttaaactacagaacaacatatcgtatcagatggcagacatacatcatttaaagggtaagaaccttaattccagattaaagataaaccaaggtcactaaatgcctaaaattgtgaagaattaagaaatagtaaattagcctagtgaaatacaattttctgaacaaactcctctgatggtaaaacatttatccttttgccttaagatataataaattatttaatgatgctttatatatgataaatccaagttaaaatttgagatctgtgtcttaaccttgagctacagacagggttatgcaatgaaatgttcttaagagaatactcaaaaaaaaattgagctgtagcttcagaagccatcaaatttctagggaaaaggtgagaagtgttccctctgtactgtgtccaatctgctaaattaattcattcaggtctagggatgctttggatagagcctccaagcttaaggttttagataccctgggaacagaaagaaacctggaaaatagataaatatataataaataaataataataaatataaaaatacacacacatatttttacttggatgaagtgataaagaggtactacagcttttatggagaaaaaaaaaaagccctgcaatctgcttatgttacttcatgccatagctgttagcctttgaagtttgggttctgaggaacaatcctcatctccctcacaccctttggttataatactgtattttaaaattttgcatgcattgtctctaggtttatgtatgtgggtagtacatgctctctagcttcaaaaatatcctttattctattatccttttgagcctctttggatatacttagataatctatttttattgtcctctcgaagtagccaaccttagctggctttgtaatgtagtaaaatttttctccttacctagcacaatcaataggaagtgtttttgtgtgttgtaaccctaaaataagttgttgatttcctattatccatgatttagaacagctttgattttctgttagaaatgctttctgggtcatcacatgggtttttgttgcatctgtgtccatgttctctttttgactcaccaaaatatattaggatgacacagaagatgccacagtgtcagtgctgcttccaacttgcaatttttacaaatgctttcacttgtcatcaaagtatacttcttattaaatgttaagaaatactattagggcttattaaagcagtaacttaatgcttattaactgtttattaaatagatcagttgaataagaagtcctgtggcttctgttagtatgtgtcaacaaaaatgacaacctgtgttactgagtaaaaatctttattgtaccatatgtgttggagtagatcttgagatattttgaaattgtgtatgatactcttcagcagagaaaaaggtcttgatttgtatgtatagctatacaacttttggttttgaagcttgggctcttaaatttgaatttaaaaatttaaaattgaaattcaataatgtgacttttgcaactggaatgatttctactgaaacaaacttcttgaaaacttgccttttataggcaagttttctttgaaattaatatctgctatagtagaattaatagacactaagacacttgagatggtttatattttcttggaaataaaggaaagttggttttttcaatcattgaggtaataaattgacattctactatcagatttattttgattagcttaccttgtttttatgcctgttactgaaagaaagttcaaagtcaaagttttctagaagtaattttctttttttttttaaagctggccccaggcaacccatttcttacctatccctaatcttttgaagttaaactaagggagtacagccatgtctttctataacataactggtgttgctttcaaagatagagcgtcctgtacaatcaacctgactcgtgttaacttactctaagagttctgctacggtgacctggagcagccacgctagacagaatatctctgggttcatataaagaaaacacatgccaatcagtcaaaagtaaaattgattttttttaacctttatttaagttcaggggtacatgtgcaggatgtgcaggtttgttacataggtaaacatgtgtcatggggcttcattatacagattatttcatctcccaggtattaagcctagtatccatcagttatttttcctgatcctctttcttctttgttttgctttctggtcttcttacttttccccttgcaaatctctgttttgacccactggaaatcaccaattacctccctgctttatgatctttctctgtattcaaataggaaataatcatattttacatgggctaaaactcatattaatgttttatttttctttgtcaattgtattttaagtcttttatcttcaattacaaaggaaaattttatttcctgatagatgaatttcaaataccatcaatgggaagctttgtggggggacagagaagccatccaagaatcttaaaatcatactaagcctcaggttcattctgaagctatttcaggtattttacagcatagcctgaatcagaagggactgtaatctttttgttccctttttcccgaggagaatgagtccgaaagatcaccaattgaagtctctttctggtagttgttaagttttgtttgttttttagttacagtttttaaatttagctttcagttctagaaactatccagcctgagcacaggtttactgaactagctagtttgatcccttagccacaaggctttttgctactgcttcctactgtgatctcattgtctctatagaatcagcattcatagctggggccagggtttctggtacctctggcctgctgtatcttaggagatggagacagggatcaggcaacaagctgaaagggttttttatggctacctggccaccacagatccatcacttttatttgagatggggggtaaatcaaccatgtttacatattggagaattaatattataaaaagagaaatttggctgggcacggtggctcacgcttgtaatcccagcactttgggaggctgaggcgggcagatcacaaggtcaggagttcgagaccagcctggccaacacagtgaaaccctgtctctactaaaaatacaaaaattagctgggcacggtggtgggtgcctgtaatcccagcaactcaggaggctgaggcaggagaatcgcttgaacctgggaggcagaggttacagtgagctgagatcgcaccactgcactccatcctgggcaacagagctagagactctgtctcaaaaaaaaaaaaaaaaagaaagaaatttaaaatgtggcttgaatatgcaaagataatgattaactacaaatattttatatgaatcattgattttttcatacttgattattatacaatagttattatgcatattgttaagcattatgtgtctcagcagatgtttatgtgacttaaatttttattcttcgttattgccacagttataattccacaataaaatttagaaagtgtagaaaaaaagtatatgttcaaaatcctactgtcagacacattcactgatagcactttgatatatttttattctagtctttttttttgcatggatgcaattatatgtttacatctgctgtttaaaaacatctgctttttatttttatttttttatttatagtttttttttttttttgagacggattctcgctctgttgtccaggctggagtgcagtggcatgatctcggtttgctgtaacctccgccactcgggttcaagtgagtctcctgcctcagcttcctgagtagctgggattacaggcatgcgccaccacacctggctaatttttgtatttttagtggagatgggatttcagcttgttggcgaggctggtctcgaactcctggcctcatgtgatccacccttctcggccccccaaagtgctggtattacaggtgtgagccaccgtgcccagccaacatctgcttttttttttttttgtctcgctctgtcactcaggctagagtgcacagtggcgtaatctcggctcactgtaagctccaccttctgagttcaagtgattctcttgcctcagcctcccaagtagctgggattacaggctcagaccaccatgcttagttaatttttgtatttttagtagagacatggttttaccatgttggccaggctggtctcgaactcctgacctcaggcgatccacccgcctccacctcccaaagtgttgggattacaggcatgagccaccacgcccagccccaacatctgctttttaaaaacagccaggcatggtggctcacgtctgtaatcccagcactttgggagatttaggcagaaggatcgcttgagctcaggagttcgagaccagcctgggcaaaatagtgagaccatctctataaatacacgtatatatctatatctccctttttactcaggaaagtggctgtatatatatctcccaagtatttttggagtgcttttagaggaataagactaattctgtaacccttctgtaaaaaatagatgttatagtattggtacattatggctagatgttatattttaatcttaatagctgttgcttatacagtataggcccctgttttcatttctaaaaattatcttaatactacttttgcttaactgctaaggctgttagctgtttttaaaatcacctatctgtgaaattaacattcactcttttccgcctgcatttcttttgtctgtaggcttagatcatgagggaatgaaatctagaacatgtgtggctggtgattatggattaaacatttacaaacaagtgtttggccaggttataatttactatccagtttggaatttcacatgattcatttccactaaaaaaattcagtcctagtccagaaattatgagctttgaaaatggaattttgggatatgtagagctaccatccatagccgaactagaaatgtatctaaagtgattggcacctatgttggtagtcgaatgtgatttaaaatgagaaagaaaacttaaaatttgtacccatagtacttttttcctactttaataaagcagatagatttgaagagataggtagttttttgtattgtctccacagcttagcatgtgtctatacaaagtgtaacaatgtgtaatttaaagaatattttgggttgatgtgaaagccactgaagctatattttttaaaaaataaatgttgccggtcaggcatggtggcttatgcctttaatcccagcactttgggaggctgtggtggccagattgcttgagcccacaagtttgagaccagcctgggcaacatggctaacccatatctactaaaaatacaaaaattagccggatgtggtgttgcacacctgtagtctcagctgtctgggaggttgaggtgagagaatcacttgagctcaggaggtgcaggttgcagtgagccaagattgcaccactgcactctaacctgagtgacagagcaagaccctatctcaaataaataaatgaataaattttattgaccatgaatgtgttacaaaaggatattaaatgtggtgtttgttatataatttaatttcctgggagtattactaaagaaattgagaattatgtataattaaaaaaacatcccatagcttctgaataggaagcattacaatgagtgaacttgattcctttggttcttaccttgggtggatagagcaacttgctgagcttcgtcaggaatttcttcgacaagaagaccagcttcaggactataggaagaacaatacttaccttgtgaagaggttagaatatgaaaggtaagatgttacatgcaacatatgtttatgaatctaaaatatttgtccagcttttggactcagttcatttctttctctctgacttttgtttccctttttttctcttctttcattttgttaagccttttaaattccttttctattatctttctttagctctttgaaatccagactcttttattttgataaattaaacagcatgaagtatctcttagagggcatgttgagtttgtgtatgttgtagaattcattgtgagagaaaatcttacaagctctgagttttattagatgtggcaaagatggaaagaagatttgtgattctttttgacggacatccagaagatgaaaccagcactgggagatgttcccagaagagctgagggactgagtgccggctgctcttcctgctctgcatgtcagccctcttgctgatacctctacacttggtgatgaggttggggatcctcttacaggcctttctagcaatcacgccttaaaacttttattatatttgtaatcaattttatggtaaaagatattttttagatttgtacaccaaaagttagaaagatttgccatattttaaagcattttgtgtccatttctgacttcttactcttgtaggttatcattgtacatttacttaaatatatgtattttaacgtaacagtattcagtatttttctgcatgtctataggattaaagatttaacgtatgtacaggtaatatattattctagcatattaatgtaccaaaacttctttagtctcttccaattgtgggaccacagtaggagttttccttttctcactttaagactatcacaggctaggttatggtggttcacacctgtaatcctaacactttgggaggctgagactggagaatcatctgagcccagaagttaaaagaccagcctaggcaacatagtgagacctctgtctctgaaaaaaatttttaaaaattagctgggcatgatggcgtatgcctgtagtcctagctgcttgggaggctgaggtgggaggattgcttgagtccaggagattgaggctgcagtgagccatgatgatgccactacactgtagtctgggcaacagggtgagaacttgtcttttttttttttttttttgagatggagtctctcacgtctctcgctctgtcgcccaggctggaatgcagtggcgcgatcttggctcactgcaagctctgcctcccgggttcacaccattctcctgcctcagcctcccgagtagctgggaccacaggtgcccgccaccacgcccggctaattttttgtatttttagtagagacgggctttcaccgtattagccaggatggtctcgatctcctgacctcgtgatccacccgcctcggcctcccaaagtgctgggattacaggtgtgaagaacttgtctctttaaaaaaaaaaaaaaaaaaaaaaagctgagtgcagtggctcacgcctgtaatcccaacactttgggaggctgaggcgggtggatcacctgaggtcgggagttcaagaccagcctgaccaacatggagaaaccccatttctactaaaaatagaaaaaattagctgggcctgatggtgcatgcctgtaatcccagctacttgggaggctgagcaggagaattgcttgaacctgggaggcagaggttgtagtgagccgagatcgcgccattgcactccagccagggtgacaagagcgaaactccatctggaaaaaaaaaaaaaaaaaaaagactatcacagctataaaaatgtctatgcaaaaaagatttcccaaaactagctgggtatgctggcatacacctgtggtcccagctacttgggaggcagaagtgggaggattgcttgagcccaggaggttgaggctacagtgaaccataatcatgcctgcactccagtctgggcaacagaatgaaaccttgtctcaaaaataaataaaaaaataaagatttcccctccccttgttatttcagtagtatattttctcaaatgtagaattcctctaaaagaatgatttaccagttttgttgcttttacagcatagatgaaaggttgctttctaaaatgattgtactcatttataatgtagacatttccccatagccctaccaaatttggttttaattctaatttaattttgttagtataggaataagatactactatatatatatacatataggaagttggtgggtttttttgttttgtgttttgtgtttttctttttttgagactgagtctgtttctgacgcccaggctgggagtgcagtggcacaatctcagctcactgcaacctccacctcctgggtttaagctattctcatgcctcagcctcctgagtagctgggaccacaggcacgtaccaccatgcctggctatattttttgtatctttagtagagacagggtgtcattgtgttggccagactgatctcaaactcctggcctccagtgatctgcttgcctcagcctcccaaagtgctgggattgcaggtgtgagccaccctgcctagccacatataagaagtttaatttgcattttataatggtgaaagttaacatttttctatatgtgtgttaactgtttctttttgcatgattggtgtatgtgtatcctttgactacttggctagcagaaagtcaccatctttatctgttttgctgctgttcactttctcctgatggcaccagtctatcttctttattagtttctttcgttcctagtattctatggtttagccttttattacagtgttaaactactattggatgaatcttctgctgccacttcttatcagctctcataattctagctttcctcatctgttactataaattggtctcacagttttctcttctatagtatttttctcttctgtgattgaagttggttttgaaagtttttttttaatagatgcaatttatggaaataataggaaaagaattgtttttatctttgtaatttctgttttctcaattagctttatcagtattatctacctcctattacaagttcaagtattttaaaagttttgattgtgagctatttgtatgctctgttttttccagcccactctcccctgctaactgagtgttttatctttcttatgtatgtgtcaacttctggacaactttgagaatccaatccaagataatataatctaaaagaatgactttgtaatttagttttcagtgtggacagcagatgaaggaattgagagcacagcatgaagaaaatattaaaaagttagcagaccagtttttagaggaacaaaaggtaaattttaaaaatatacttaaatccaaatatttttattataaatcatggtaatttagaaattaaaattataattttgtcacaaaacactatattttaagttttccagccagcctaattccaaaagtgatttacaatggctttatttctgagtaaattaaacatttgcaaaaatataatcttaattcttaaaactggtcgggcacggtggttcacgcctgtaatcccagcactttgggaggctgaggcgggcggctcactcgaggtcaggagttcaagatcaccctggccaacatggggaaaccccatctctactaaaaatacaaaatatagccaggcttggtggtgtatgcctgtaatctcagctactcaggaggctgaggcaggagaaccgcttgagcctgggagacggaggaggttacaatgagccaagatcacaccactgcactccagtctgggcaacagagtgagactccgtttcaaaaaaaaaaaaaatttaaattaattttgaaccaaaatatccatctttttaaaaaaataatttttgttgttaatatatttctcagattgtaaagtgggcaacttttttactgaaaatcaactacttccttttttatacatttgagaaatagaaaaaaaagaaacactttttcctttatcatcagtctctgttattctgacaccctttcctaaagcacagaaatgagacactagccactacaaccaatttgattcatactttttttggggggggcaaattcttttattaattcattttaagttaatatgtattatgaagattcttttagcaatagaggaaattgtctgaagattactaattattaaggacatgattcatttttttttgtgtgtgtgatggagtctcgctctgtcgcccagctagagtgcagtggcgtgatctcggctcactgccagccccgcctcctgggttcacgccattctcctgcctcagcctcccgagtagctcggactacaggcgcctgccaccacgcccggctaattttttgtatttttagtagagacagggtttcaccatgttagccaggatggtctcgatctcttgaccttgtgatccgcccacctcggccttccaaagtgctgagattacaggcatgagccaccgcgcacagccaattcatttttttataccttgtaatcttacctaaccaggcatgatttttatgaactcttgtgatttaaaggaaaaaaagatttaatagtgaaaagtatttgttttgctctttggtagcatctcaactaaaggactagaagttaaggatatcaggttttcattcttagctttttcacaattttatagtaggatatagagggtgtcatttctttctccatttcattttttgaatctacaaagtggaatacctgctgcctatctgcagtctactttgaagaggtgtttaaggatggattggtggacgaaggcaggcctgagtgagctaccatagtagaggcattgagggcaaccaaaaggtattattgagacactggagggtcaaaagaacataatggaacacaaaaggaaggggaagagaggtttgctgttgcaattgtgtcattataagcgtagtatataaataatgggataagtttgctctcttctattctctttttttttttgagatggcgtctcactctgtcacccaggctggagtgcagtggcgtgatctcagctcactgcaagttccgcctcccaggttcacacattctcctgcctcagccttccgagtagctgggactacaggcacctgccaccacgcccagctaattttttgtatttttagtagagacggggtttcaccatgttagccaggatggtctcgatctcccgacctcgtgatctgcccgcctcagcctcccaaagtgctgggattacaggcgtgaggcaccacgcccggccgctctcttctattctcttaaggaatacagatgagagctttccctttttttccaagccagtgtaattctctttctgttcttctatactaggctatttttatgttattaattaactaatgcttctccaattcttccttgccattatcctaccctaaatggaacaaggcatggcaggaattgaggtgcccagagaacttctcctttctgggtagcacatcagcccttaccctctagatcagctacctaattctactccccacccttcatttcctgtactttaactactatggcaagttggttctgtgcaatttgagttttcatagagacaaatccaatgttagctatatgaaataagcataaattgtattcagggatttatctttttgttttattaattttaaaattaattaaccagccacatgtctatcatagaaatgactctggaaaagaagtcagcaaactatagcccgcaggctgaattcagcttgctgcctgctttcgtactgtttagaggccaaaagtggttttcacattttcaaatggttgaaaaaaatcaagaaaaaattatcttagtacttgggaaaattataagaaatttatattttggtgttcatacataaaattttattgagacacagccatgcttatttgtttactgcgttcatgctgtaagggcagagaaactctcatagcccagagaagactaaggagactaaggacttaaatgcagtgtagtagctgggggcggtggctcacacctgtaatcccaccattttgggaggccaaggtgggtggatcatgaggtcaggagttcgagaccaacctggccaacatggtgaaaccccatctctactaaaaatacaaaaagttatccgggcatggtggctggcacctgtaatcccggctactcaggaggctgaggcaggagaatcctttgaactggggatatgggggttgcagtgagccagtactgcaccactgcactccagcctgacagcagaacgagactacatctcaaaaattaaaaaattaaaaaattaaaataaatgcagtgtagtatcctgaattggatcctgaaacagaaaaaggacttagtggaaaaactggtgaaatctaagtaagtctggagtttaggtagtaataatatactgattttcttttttagttttgcaaatgtatcatggtaattatggatggtaggttaacaggattttaacattagggaaaactgagtaaggggtgattacttttctgtaaatctagaattatttcagaataagaagtttattttaaaaacaatcaggaggcccactaaccaaatcacaaacattacatctagaaaagcatcttattttattaatattaatattgtccattcatagaaaggtactgtcaatagtacattaaagatacaacatctttgttaactattttcaatggaaaagtatttttgaacagtagcttgttgacttttaattttgttcaatatttttcttatccatatctggaaaagagtgaagagtactatagcaatagccttatgagatagcattatagtgaagatgcacagacatgcaagctggctgctcaggttgtacctcatggattttctcacccttggtgtttatattgacatgttcaaaaatttcagtttatcatttcattcatcaatgattaaactatcagaattgattatagcttaccaacttacaggaaatgtgggatttggagtcagaaagactgtggttagaattccttcttcacaattctctagttttgtgactttggacaaactgcttttttttttttttttttttctgagacagagtcttgctttgtcacccaggctggagtacagtggcccgatctcggctcactgcaacctctgcctcccgggttcaagcgattctcctgcctcagccttctgagtagctgggattacaagcatgcgccaccatgcccgactaatttttgtatttttagtagagacggggtttcgccatgttggtccggctgattttgaactcctgacttcatgatccacccgcctctgcctcccaaagtggtgggattacaggcatgaaccaccgtgcctggcccaaactacttaactttttctatttaatggagtgttgcactgttgcccaggctggagtgcagtggtgccatcttggctcactgcaagctccgcctcccgggtttacgccattctcctgcctcaggctcccaagtaactaggactacaggcacccgccaccacacccggctaattttttgtattttttagtagagtcggggttttactgtgttagccaggatggtctctatctcctgacctcgtgatccgcccacctcggcctcccgaagtgctgggattacaggcatgagccgccgtgcctggcccaaactgcttaagtttttaatacctcagttttgtttttctcaaaactattaattttatttctactagaggacagctatgaaggcaatttggaaactatgagacacgatgcaaatatttattgttgattttacttgccaggacactggaatacctacacctaattgtcagagtactctttctcctttattgtgacacactcttaagatttggctgttgtggccgggtacggtggctcacgcctgtaatcccagcactttgggaggccgaggttggcagatgacgaggtcaggagatcgagaccatcctggctaacacagtgaaaccccgtctctactaaaaatacaaaaaattagccgggtgtggtggtgggcacctgtagtcccagttactcgggaggctaaggcaggagaatggcatgaacctgggaggcggagcttggagtgagccgagatcgcgccactgcactccagcctgggcgacaaagcaagactccgtctcagaaataaataataataaaaaaaaatatttggctcttgtttttctagattccatatagatttttcgtactatttttataacattactaagaattatatttcatactgcattagagtttacaaagcatttatagatgcattaaatgttgactagaggaacctgtatatggcatcccaagcttgtgtacttgaatccttgctgctcccaattttccatggaggcaaacttaatactggtccaccaagagaattgagttaggcctaaccatgtacctgaagattcacatttccaagaagatgctaggttaggaacaggttagaggaagcactgacctgtttattgtcctgccactacttgctgtgtttcggtggccagcacacttaggaagaagattgcctgtttttcacccttgctcttgaagaggcacctgtgtaccagtctcctccttactgccatcctgcttggttctaacatatgcttacagagaacccaccctgcccatagcacccaggaagatgcccaattttaggccattagggtaacctagagtattcagcaggctgtcttgcagaatcacacacctcagcatagccaagcagagtcacctctgcctaccaaatcattcatttactgtagctagagattttcaaaagtgttattctttgactttttatcaggtataaaaatcacacagaaaataatgtatcctgcatctccaattgttcattatttgaacccatggtatatgttttacaagatgaactgtttcagaacatttaattaatagttgtgtcggtggtttaacaatttgaactgaaaaatattattaccaaattttgtctaacagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaaggtattattgttattattcttttgttttgtattaataggatattgactttttcttcccattttgaagtggatattttcaatcataaagaaaattgtttgattttagttcacacatgattaagtgtctgcattgtttcaaatttggattgtttgatagaagagaaaaaagagtaagttattttagagttacagctatgtccaaagcaagaggtaaagatgttcagttgatgtagcctattacttttagaaactgattgttacattccttcaaaacattttcaaattatgtaagaaaaacgatagaattctatctttttgttacttgggcagaacaaatcaaaagaggtggtgatgcagggatgcctggaatagaagagaatgacctagcaaaagttgatgatcttccccctggtaagtaaaaattgttagagaattcgactaaagtgatgataatacatttcatgtgaccccattctctttttcggtaacacttggaaaagtcacagatatctggatgatcgatatttctacttaattaagtacccattaattgccaggactttttttggatccaacttttataaaattttttgctaagatgtataaaatacttgtttttgccttgataagaatcacctatatttgaatcttttctttgcgactctgagtttttgcttatgacagttgtactatatagagtcatttatgtttactaaaagtatgcatggctcttttctttcccaccaaatgtgcccagattcctgtgttgttggtgtgctttaatatggcatagtaataccctaataagagttatttaattatttagttttgagggcttggcttgtccttttagtgaattaccccacacttttggatagtttgtttaacattttttttcttcttttctggccacttctgttcattgtatgtctctttcctccttaatgtgtctgctgcttatccattttcacttgaaggcctgctcccacttgctgctattctaatccccttcatttttttccttcatgtctcttctttgtttttcttgccatatctatgtttcttggctattaatggtactcctccctgctgactccaatttattagggtagaaaaataagaaattaacagcatgcctctactgcttttggctgattttatttcttctcagtctcagtaattacttctgtgattatagctagttgtacatgactgaaattgctgaatgtttagatcaaataaatgaaatatttgtcctttcatttatatagttttattgtcttctcaaattcttatgggtttccaattcatagtgatttcccctaaaataaaggtaaggacaaaagcaataacatgaatttgaaaataaagaatcagaattagcaagctttgtttgtaagacaatgaagtaatccagtgattttttaaaattaattaattaattaattttgagatacagtctctctctgttgcccaggctggagtgcggtggcgtgatcttgtttcactgcaacctcagcttcccaggttcaagcatttctcctgcctcatcctcctgagtagctgggattacaggtgtgtgccaccaagctcagctaatttttgtattttcagtagagacgaggtttcaccatgttggccagctggtctcgaactcctaacctcaagtgattctcccaccttggcttcccaaagtgctgggattacaagcatgagccaccaagcccggcctctttttaaaattttgagacagggtctcactctgtcacccatgctggagtgcagtggtgcagtcatggctcactgcagttttgatctcctgggcgcaagctatccatccacctcagcttcctgaataactgagactacaggtgtgtgccatcatgcccagctaattttattttttattttctttatttttttatttttgtgatatgggatctcgctctgtcacccaggccagagtgcagtggcatgatcacagctcactgcagcctcgatctcccgggcataagcgatcttcccacctcagcctcctgagtagcaggaactacaggcatgtgccaccacacctgactaatttttatagtttttttgtagagataagttttcaccgtgttgcccaagctggtctcgaactcctagccttaagcaatctgcctgccttggcctcccaaaatgcagggattacaagcatcagctaccatgcccagcctattttctttatttttttgtagagacaaggtctcaccatgttgcccaggctgatctcaaactcctgggcttacgtgatcctcccaaagtgctaggattacaaacatgggtcactgcacccagccaaaaaatatagagagagagagccaaaaattacatatatttttttcagagacagggtctcattctgttgcccaggctagagtgcagtgatcatagttgatggtggcctcaaactcctaggctcaagccatcctcccacctcagccttctaggactacaggcacacaccaccacacctggctaatatttttatttctgtagagacggtgcctcactgttgcccaggctactctttaactccagtcttcaagcgatagtcccgcctcagcctctcaaagcactgggattataggcgggagctgtggtgcctagctgtaattcggtgatttttaaagtgtggtctttggatcagcagtgtcagcattacccaggaacctgttagacatgcaaattcttaggtctcattccagacctacttaatcagaaattttggaatggagcccagcaatttgttttaaaaagctctcctagtgattttgatctatgctaaaatttgagaaccactgacttagatgttaatttaaagaaatgttcagagcaggaactctgtattcttccaaatttttgtagcacttactctagtcctaggcacagttgagttttaggttgattaatctattttacattgcggttgtgtattttaaaaactatacccaaagttttgtcaaggacatactgctggtttctgatacatagaagcactctattcagatatgagcaacagttggctacctgcatacattaatttttcatgtaatatacctgaaaaatgtattatttgtgtttaaatatatataatttttgacctctattatttatttccacatacttttctctttttttttttttttttttgagacagagtctcactctgtagcccaggctggagtgcagtgatgcgatcttggctcactgcaagctttgcctcccaggttcatgccattctcctgcctcagcctcccgagtagctgggactacagatgcccaccaccacgtccagctaattttttgtatttctagcagagacggggtttcaccatgttagccaggatggtctcgatctcccaaccttgtgatccgcctgcctcagcctcccaaagtgctgggattacaggcgtgagccaccacgcctggcatatttccacatacttttcaagttaaaattttatcattattactctaaatgtgtaatgtctccatttattttctcattggtcataatttattacccagccaccaggaaattccagtgtttagggtaaaatgaaatgggaatacaagagatcttagagatcttgtcttgaccattattaggtatattgtcctatcagacagtggttttcaaatgtctttcatatatgaaccactccagcaggatagaaatcttatcttgccgcttctgctttcttaataataatttttaaaaagtacacaacaattttattagatttttttttttttttttttttttgagaccgagtttcactctgtcgtccagcctggagtgcagtcgtgcgatcttggctcactgcatcctcggcctcccgggtttaagcagttctctgcctcagcctcctgagtagctgggattacagcgcccaccaccacgcccggctaattttttttgtatttttagtagagacggggtttcactatcttggtcaggctgatcctgaactcctgacctcgtgatccacctgcctcagcctcccaaagtgctgggattacaggcgtgagccaccgcgcctggccaattttattagattttataagaatgaatagcgctacttttgatgagatgccaacaaattcatatctgatttttacaatgtgaacttgccatatgcaacttacatggttgcagcactataatttggaactgggaaaaacaccacgtgtattaacattttgtgtaaattgatcgttaatgtaaaaaatgtcaccatatgcagacattttctacattgtcatggcatattaaaggccttcctctggattgtttttttttttacttttatttttatttatttatattttttgggacagggtcttgctctgtcacctaggctggagtgcagtggcatgatcatggctcactgcagccttgacctcctgggctcaagtggtactcccacatcggctcccgagtagctgggactacaggcatgtgccaccacatccagctaattttattgttgttgtttgtagagacagggtgtcgttatgttatccaggctggtctcaaactcctaggctcaagcagtcctcccaccttagcctcccaaagcactgcaactacaggtgtgagccaccatgcctggcctggattaatatttgaagctctttaaactattggtgctttgctttgataatcatttttcatagcaattatccttaattatttgaggaagtattttgagtgtaaagattattttgaaatggtaactggtagaaggaaactttgagctctgtgatcattcggatgcaaacacgaaggaaagccatttcatatctttgtatctggagctccctacatgctgccttgcatatagcagggtcccagtaaatgtgtatggttgaattatcaggctatctttaatggtgagacaatggtctctggagtcaaattgcctagattcaaacctttggctcttatcttttaacaattatgtgacaattttttgcccttatatgtaaaatagaataataacaattccagcctgacaggaatgttgtgaaatttaaatgtaaaacacttagaacagtgcctggcacatagcaagtgctatatatatcttagtttctattggccgggtgcagtggctcatgcctgtaatctcagcactttgggaggctgaggcaggcagatcacttgaggtcaggagttcaagaccccctggccaacatggtgaaaccccatctctgctaaaaatacaaaaattagctgggtgtggtggtgggcacctgtaatcccagctactcgggaggctgaggcaggagaatcgctagaatccagaaggcagaggttgcagtgagcgaagatcatgcctctgcactccaacctggaagacagaaaaaaaaaaaaaaaccaacttagttgttgttgttattattatttcatgtaattgtagccccatttttaatctctttgccactcctttttctcagttttgtcttttcttcctgaagtagagtatgccaaaattcttaatgtcaatgtaagttctggtgtatatgtggtgtcctattagctatagaggcagtaaccccaaagaggaagcagagaaaagaacatatcctggctgggcatagtggctcatacctgtaatcccagcactttaggaggctgaggcgggcggatcacttgaggccaggagtttgagaccagcctggccaacatggtgaaaccccgtctgtactaaaaatacaaaattagctgggcatggtggcacacacctgtaattccagctacttgggaggctgaggcaggagaatcccttgagcccaggaggcagagctgcagtgaactgagatcgcgccactacactccagcctgaacaacagagtgagactctgtctcaaaaaaaaaaaaaaagaaaaaaatatatatccttgtaatttaaaaatggactgttatatatactgacagttttgtttaagatagctaggaccatactagaaattatggtagagcaatgggaaactatctttaaatatacctctgaggccgggcacagtggctcacgtctgtaatcttagctgagattacagctggataggctgaggcgggagggtcgcttgaacccaggagtttgagaccagcctgagcaacatgatgaaaccctgtgtctacaagaaatagaaaaattagccagtcatggtggcacacgcctgtagtctcagctactcaggaggctaaagtgagagaactgcttgagcccaggaggcggaggcttcagtgagcagagatcacaccactgcactccagcctggtgtcagagcgagaccctgtctcaaaaaaaaaaaaaaatgtatatgtgtgtgtatatatatatatatatatatatacctctgaaatagtcaagggttatagagcatgtgcctagggttagcattttgtttcagcttctcagctcccaaagccatacagtgaacccttactgggttttgtttgtttttaatgcttgatttggaactaatcgccaagactttacaggaactttatgatttaatgaattaccttcttgacctggatacttacctatatgctgatttagataactgtaatgttaggcagttacatatttatatcagtagtttttaaacttttaaaatctttttgttatttattattttttatttttagagacaggatcttattctgtcatccaggctagagtacagtggcatggtcatagcttactgcagcctcaaactcctagacccaagcaatccttctgccttaccttctagaggggctgcgattacaggcttgtgccaccacatgcaaaacttatttatttatttatttaattaatttttttttttttttgagtcggagtctcgttctgtcgcccaggctggagtgcagtggcgcaatcttggctcactgcaagctctgcctcctgggttcgcgccattctcttgcctcagcctcctgagtagctgggactacaggcacccgccacaagtagctgggactacaggcacccgccaccatgcctggctaattttttcttttttttttttaatacagacggggtttcaccatgttagccaggatggtctcgatctcctgacctcgtgatccgcctgcctcggcctcccaaagtgctggaattacaggcgtgagccaccgcgcctggcctatttttttattttttgagatggagtttcgctcttgtagccaaggctggagtgcaatggtgcgatctcagctcactgcaactgccgcctcccaggttcaagcaattctcctgcctcagcctcctgagtagctgggattacaggtgcccgccaccacatccagctaattttttttttttttgagacagagtctcgctgtgtcgcccaggctggagtgcagtggcacgatctcggctcacggcaagctccgcctcccgggttcatgccagcctctgagtagctgggactacaggtgcccgccaccacgcccagctaattttttgtattttagtagagacggggtttcaactgtattgcccaggctggtctcgaactcctgagctcaggtaatccgtccgcctcggcctcccaaagtgctaggattacaggtgtaaggcactgtgcccagcctttcttcttgatatttaggagttctttaacagtatgcaatgcaaatatcttctctgtattatacctataaacaaagaggaaaatcgtatttctttcttggaaactcttttttagctttaaaaatccaatcagtcccagtaaaaatgtaaaaattacccctactgacttactttgggggaaaccctctataggtataaagatatttaagtacctgagcaattgaaagttattttcctaattaataacttggaaagaaaaaaattactcccttggttcttatttttctttatttttatttttattttctatcaacagcatccaggaaaagcttttaggttttgtgtgtgtgtgtgtgtgtgtgtgacagagtctcgctctgttgtccaggctgaagtatagtagcgtgatcttggctcactgcaacctgcgcctcctgggttcaagcaattcttctgtctcagcctcccaagtagctgagattacaggcgcctgccaccatgcctggctaattttttgtatttttagtagagatggggtttcaccatgttggccaggctggtcttgaactcctgacctcaggtgatccacccgcctcggcctcccaaagttctgggattacaggtgtgagccgcagcacctggccaggcttttagtttttaaatattaggtagaggtaatctatttgtaagataacagattttctagaacagaggcttcgaatggtggttgcatattggaatctctggggagcttgaaaaaaaaaaagatactgatgcctaaattccattccagagattttgttatatttgttctggggtttgacttgggcattgaaggtttaaatggtcactaggtgattacattatgtagctaaggcagaaaaacctttactctagacagattctctagatctatactgtattaatgcagtagccattggtcacatgtggctatttacatttaaattcattacatttaggtgaaattaaattcagtttcttagtcaaactagctacacttaaagtgcttacttagtagttacctgtggctaaaggcaactgtgttggacagcaccaatgcagaacattttcattattgtagaaagttctgttggacagtactgctctagattgaaaccagtaatagtggttttatggggaagaagattaggacagggatgaaaaggtgacttgcttttcattatataatcttctgaacttttaaatttttgtataatactaataaactacctattcaaaaaaatcattatttaaaaaaattaaagagaggctaggtgtagtggcttacgcctgtaatcccaacactttgggaagcctaggcaagaggattgcttgaggccaggagttcgaggcttgggcaacataacaagacctcatatcttaggaaaaaaaaaaatggctaggcatagtggcacacacctgtagtcctagctacttgggaagctgaggtgggaggatcacatgagcccaggagttcgagattgcagtgaactgtgattgcaccactgtactccagtctgggtgacagagagagaccctgtctaaacaaaaaagagagagagagagagagagaggaggcagagtgagataactgaatagaagcctccactgattgtcctccctgcagtagcaccaaatttgacaactgtctacacagaaaagtaccttcatgagagccaaaaatcaggtgagcaatcacagtacctggttttaacttaatattgttaaaaggggcatggaaggagtaggaaagacagtcttgaattgaagacaccaccccccaacccctgcagtggccttgtggcatggagagagaatctatacacttccaggagtgagagtgcagtaattgtgagactttgcactggaacttagtgctgccaacactgagcagaactcagccaatgcccacagaggaagcctgtggactaaccctagtcagaggggaaattttctctcccagcaggcagaacttgagtttggctagccttgccaccgcgagctagagtgctttggggtcttaaatgaactagaaaagcagtctaggctagaaggactgcaacccccaggcaagtactagagtagtgctgggatcagagccagtggtcttgcgggggcacacaacctagtgagacagcagccagggtgactaaggaagtgcttgtgtcaccccttccacacagtgccagccagtgcatcttgccagtacaaaagagaccccttccttctgtttgcggacaggaaagggaagagtaaagaggacttcattttgcaacttgaataccagctcagccacaggcatctagggtaccaagtagagttgtgagacccctattccaggccctagatgcctatagtgtctagacacagtcagcgccagaagggaacctcctgccttgaagggaaggacctagacctggcaagattcatcacctgctaactaaagagcccttgggccctgaataatcagcactggtaaccagataggagatgccatggccttgagtgagactctgagacatgctggcttcaggtatgacccagcagtagcgactgcaagtaaagactctgcttaacaaaaggagagggaagaataaaggagattaggtcttgcagtgtagatttgaacttggtcatagttgggaagagtaccaaatgggctcttagggtccctaattccaggccttagctcctggatggtagttctggacctacactatgctagaagggagcctgttgctctgaagggtgagtcccaggcctgagtgttcacaagatgactgaagagcccttgggccttaagtgaacactgtcgataccctggcctccccatgggaggccacagtactccccatgggcctgtggtagtggtggacacagggagagactgagactctgttttggtgccaaacttactgcagtagaaagaataccaggtagatttctgacatttccaattctaggccctggttcccagacatcatctctgaacctgctgggggaatttgccaccctgaaaggaaggacacaagcccagctggcttcatcatctgctgattgtggagctctagggccttgagcaaacatatgtggtagccaggtagtggttacagcaggccttggtaagacccagtgctgtattggcttcaggtctaacccagcacagttctaatggtggtgccacagtggtacatgcctatagtcccagctactccagaagctgaggtgggaagatcacttgagcctgggagattgaggctgcagtgagctgagatcatgccattgcactccagcttgggcaccagagcaagaccttgtctcaaaaaaagaaaaaaaaaaattaagacccaacaatctgttgcctacaagaaacacactcacctgtaaagacacacataggccgggtgcagtggctcacacctgtaatcccagcactttgggaggcaaaggcaggcggatcacctgaggtcgggagtttgagaccagcctgaccaacatggagaaaccccgtctctactaaaaatacaaaattagtgggacgtggtggtgcatgcctgtaatcccagctactcgggaggctgaggcaggagaatcgcttgaacccgggatgcagaggttgcggtgagctgagatcgcgccattgcactacagcctgggcaacaagagtgaaactccgtctcaaaaaaaaaaaaaaaaaccacacaaagactgaaaataaagggatgagaaaagatgttccatgcaagtagaaaccaaaaaaaagagcagaagtagctatgcttaaacaaaatggatttcaggacaaaaactaagagacaaagaaggtcattatatataaaagggtcaattcagcaatgggatataacagttatacatatatatgcacccagcattggaacaccctgatacataaagcaaatattagagctaaagagaaagataaatttcaatacaataatagctgaagacttcaacaccccactttcagcattggacagatcatccagacagaaaatcaacaaagaaacatcagacttcatctacactatagaccaaatggacctaatagatatttacagaacatttcatccagtggctgcagaatacacattcttctcctcagtacatgcatcattctcaagggtagaggccatatgttagaccaccaaacaagtcttaaaacattcaaaaaattgacgttatatcaagtatcttctctgaaccacaatggaataaaattataaatcaataacaagaggcattttgggaactatacaaacacatggaaattaaacaatatgctcctgagtcactagtgggtcgatgaagagattaagaaggaaattgaaaaatatcttgaaacaaacataatggaaacacaatataccaaatcctgtgggatacagcgaaagcagaactaagagggaagtttatagctataagctcctacatcaaaaaagaagaaaaacttcaaataaacaacctaacaatgcatcctaaagaactagaaaagcaagagtaaaccaaacctaatgttagtagaaggaaaaataaagatcagagcagacataaatgaaattgaaatgaagaaaacaatacaaaagatcaaggaaagaaaaagttggtgttttgaaaacataaaactgacaaacttttagccagactaagaaaaaaagaagacccaaataaagtcagaaatgaaaaaggagatattgcaatagatactgcagaaattcaaaggatcactagagggtactatgagcaactatatgccagtaatttggaaaacctagaagaaagggttaaattcctagacacatacagtctactaagatagaaccatgaggtaatataaaacttgaacagactgacaacaagtaacaagttgaagctgtaataaaaagtcttccagcaaagaaaagcccgggacccaatggcttcactgttgaactctaccaaacacttaaagaaaaactaaaaccaatcctattgagactattctgaaaaatagaggaggagggaatacttccaaactcattctaggagacgagtaatagcctgataccaacaccagttaaagacacatcaaggaaaaagaaaaccacagaccaatatctctgatggacattggtgcaaaaatccttaacaaaacactatcaaaccgaattaaggaacatattaaaaagatcatgtatcattgaacaagtgggttttatcccagggatgaaaggatgcttcagtatacatgactcaattaatgtggtatgtcgtatcaacagaatgaaggacagaaaccatatggtcatttcaattgatgctgagaaagcatctgataaaatttaacatctcttcatgataaaaatcctcaaaaaactggatgtagaaagaagaacatacctcaacataataaaagccatatgtggcagacccacagctagtatcatactgaagagggaaaactgaaagccttttctctaagatctagaacacgaagtggatgcccactttcaccactgtcatttgatctagtactgttatttgacctagacttccagtactagtactggaagacctagctagagcaataagaaaagagaaagaaataaaggacatccaaatcagaaaggaaggtgaaaggattcccactttaagcactgctatttaacctagtactggaagtcctagctagagcaatcagacgaaagaaagaaaggtggccaggtgtggtggctcacgcctgtaatcccagcactttgggaggccgagttgggtggatcacgaggtcaggagatagagaccatcctggctaacatggtgaagccccgtctctactaaaaataacaaaaaattagccgggcgtggtggcgggtgcctatagtcccagctactcaggaggatgaggcaggagaatggcgtgaacccgggaggcacagcttgcagtgagctgagattgcgccgctacactccagcctgggcaacaaagcaagactctgtctcaaaaaaaaaaaaaaaaaaaaaacacagacaaacaaagaacatcaaaatcggaaaggaagaagtcaaattatccttgtttgcaggtgatgttatatttggaaaaacctaaagactccaccaaaaaactattagaactgataaattcagtaaagttgcagcatactaaatcaacatacagaaatcagtagcatttctatatgccaacagcgaataatctgaaaaagaaatcaggaacataatcccatttacaatagctacaaataaaatacctaggaattaactttaccaaagaaatgaaagatctttacaatgaaaactgtaaaacattggtgaaagaaattgaagaggacacacacacaaaaaggaaagatattccatgttcatagattggaagaatcaatattgttaaaatgttcatactacccaaagcagtcacagattcaatgcaatccctatcaaaatatgacattcttcccagaaatggaaaaaacaatcctaaaatttatatgaaatcataaaaggcctagaatagccaaagctatcctgagaaaaaagaacaaaataggaggaatcacataacctgacttcaaattatactacagagccgtagtaaccaaaacagcatggtactggcataaaaacagacacatagaccaatgaaacagaatagagaacctagaaacagttcatacatctacagtgaactcatttttgacaaaggtgccaagaatatgcactggggaaaggacagtctcttcattagatggtgctggggaagctgaatatccatacacagaagatcgaaactagctccctgtctctcaccacatacaaaagccatatcaaaatgaatttacgactcaaatctaagacctgaactatgaaactactaaaaacaacattggggaaactccctgggacatcagactgggcaaagatttcttgagtaaaaccccacaaacacaggcaaccaaagaaaagatggacggatgggatgacatcaagttaaaaaagctctgcacaacagaggaaacaatcagaaaagtgaagagtagccaggtgcagtggctgacacctttaatcctagtactttgggaggccggcagatcacctgaggtcagaagttcgagaccagcctggccaacatggtgaaaccccgtctctactaaaaatacaaaaattacctgggcatagtggcaggcacctgtaatcccaactactcaggaggctgaggcaggagaatcgcttggacctgggaggcagaggttgcagtgagcccagatcgcgccattttagtccagcctgggcaataagagcaaaactccatctcaaaaaaaaaaaaagaaaagaaaagaaaagtgaagaggcaacccacagaatgggagaagatatttgcaaactatctatctgacaagagataaataatcagactatataaggagctcaaacaaccatataagaaaaaaaatcttataattcagttagaaaatagacaaaaggtctgaatagacatatgtcaaaagaagacgtacaaatggcaaagcagatatatgaaaaagtgctcaatatcattggtcatcaaagaaccataaatcaaaactataatgagatatgactttagcctgtttaaaatggattgtatccaaaagacaggcaataacaaatgctaacaaggatatggagaaaagcgaaccctcatacaccattggtgggaatgtgaattagttcagccactatgaagaacagtttggagttcctcaagaaactaaaaatagagctaccatatgatctagccattccactgctaggtatgtacttaagagaaaggatatgacctggcattcatatgcagaaaaatatatatatagaaaggaaatcagtatattaaagagatatttgcactctcttgtttattgcactattcgcagtagccaggatttggaagcaacctaagtgctcatcagcagatgatggataaggaaaatgtggtatatatacacattggagtactatttagccttaaaaaagaatgagatcctgtcatttgtaacaacatggatggaactatggtcattatgttaggtgaaataagccagacacagaaagacaaacttcacgtatcctcacttatttgtggtgggaactaaaaattaaaatagttgaactcatgggaatagagagtagaataatggttaccagaggctgtgaagcttattggggaagggtaagggggaagtggggatggttaattggtacaaaaaatagaaagaatgaacaaggtctggtatttgatagaacagcagagtgactaaataatagtttaattctatgtttttaaacacctgaaagagtataattgggttttaacacaaaagataatgcttgaggtgatggatgccccatttaccctggtgtgattattacacgttgtatgcctgtatcagaatatctcctgtacctcataaatatatacacctaccatgtacccacaaaaattagaagaagaaaatgtaagtaatgcatttcctcaaaaaattataggtaattagtattaatccactgtatgtaattgacatctattaaccacttcatccaacaacagcagggactcattcttctcaagctgtcacagaacactcaccaagatagaccataaaacgggaattgaacaatgagaacacatggacacaggaaggggaacatcacacaccagggcctgttgtgtagtggggggaggggggagggatagcattaggagatatacctaatgctaaatgacaagttaatgggtgcagcacaccaacatggcacatgtatacatatgtaacaaacctgcacgttgtgcacatataccctaaaacttaaagtataataataataaaataaaaataaataaataaaataaaataaaatgagacagcaaccacacacaaaaaaatacttataaaacagattttaaaaaatattaatcacataatgtctactctcagacctcagtggaattaaactgaaaatcaatagagaaagataggctctctgttccttctgtgtgataaaggacacagcagcagccatgcagcagcagccatgcagcagcagccatgtccctgagacagttggtgaaattgaaggttgtagtaaacacatttggctgtactgggcatctggtcaactgggctgcttttaactctggcaaagtggatattgtcatcatcagtgaccccttcactgactccagctacatggtctacatgttccagtatgattccaccagtggcaagctccacagcactgtcaaggctgagaatcacaagtttgtcatcagtggaaatcctatctccatcttccaggagcaagataccaccaaaatcaaatgcagtgatgctggcactggttgtgttgtggagtcaactggtgtcttcactatcttgtatatggctggggcacacttagaggagagagccaaagagtcatcatctctgctgcctttgaccccctgtttgatgggcatgaaccatgagaagtacgaaagcaacctcacaatcatcagcattgcctcctgcaccaccaactgcttagcattctctgaccaagatcatccatgatagctctggcatcatggagggactcctgaccacagtccctgctatcactgccacccaggagacctatggatggcttttctgggaaactgtgacgtcatggttgtggagctctgcagaacattattcctgcatctactggaacttccatggctgtgggcaaggacatccctgagctgaatggggagatcactggcatggccttcctcgtccctaccaccaatgtgtcagttgtggacctgacctgctgtctggagtaacctgccaaatatgatggcttcaagaagatggtgaagcaggcatcggaaggcccttcgagggcacactgggctacactgaacaccaagttgtcccctgtgactttaacggtgacactccctcttccacttttaattctggggctagcattgccctcagcaaccattttgtgaagttaatttcctggtatgacaattagttttgctacagcaacggggtggtggacctcatggtccacatggcctccaaggaataacagccctccggactaccagccctagtgagagcacgagagaaaaagagaggctctcagctgctgaggagtccctgcctcactccgtcccccaccacaccaagaagctcccctccaccacagttttcatgccatatcccctgaagaatgggaggggtctagagagcccccaccttgtcatgtaccgtcaataaagtcttctgtactcagccaaaaataaaataaaataatagaaagataactggaaaatcccaaaatatgtggagattaaacaactatttctgaataatgcatggatcaaagaagaaatctcaggagaaatttaaaaatattttgaactaaatgaaaatgaaaacactacttatcaaaatttataggatgcagtgaaagtcatgcttagagggaaatgtatagcagtgaatgcatatgttagaaaagtagaaaggtctaaaatcagtcatttaagtttccaccttaggaaattgaaaaaaaaaaggcaaattaaatccaaagtaagcaaaataaaagacataataaaaaattagaacagaagtcaataaaattaaaaacaggaaatcattagagaaaatcaatgaaaccaatagctggttctttgacagtattaataaaaatgcataagcctctagcaaggctaagagaaaaagagagaggacacagattacttctgtcagaaatgaaagagggttatcactacagatcccatggacattaaaaggaaaataaaggaatactatgaacaactctgtgcctaccaatttgataacctagatgaactagaccacttccttgatagacacagtctgccagctctacaaaaagataatctgaacaggtttatatgtattaaataaattgaatcaataataaccttccaaagcaggaagcaccaggtacagatgggtttgccggtgaattctaccaaatatttaagaagaaactataccccttatctacagtctctttcagaagatagaagcagagggaatacttcctaattcattctatgatgccattgttatgccagtaccaaaaccagagaaagacactactacagaccaatgtctctcatgatcttagatgagacaaaactacagaccaatatctctcttgatcttatatgcaaaaattctcaatgaaatattagcaagttgaattcaacaatgtatacaagaattataggccaggcacagtggctcatgcctgtaatcctagcactttgggaggccaaggtgggcaaattgcttgagctcaggagttcaagaccagtctgagcaacatggcaaaaacccatctctataaaaaaatacaaaaactagccaggtgtggtggcacacccctgtggtcccagctactcaggaggttgagatgggaggattgcttgagcccaggagatggaggctgcagtaagccaagatcacatcattgcctaggtgacagcaagaccctgtccccaccaccacccgccccccaaaaaaaagaaaaagaaaaaagtgtatcacaagcaagtgggatttatcccaggtatgcaaatctggtttaatattaaaaaatcaagtaacataattcatcgtattagcaggctaaaaaaaaaatcacatgattatatcagtgaatacagaaaaagcatttggcaaaatccaaaactcattcatgataaaaacacagttaactaggaatacagggaaactttctcaacttgatacagaatatctacaaaaaaatctacaagtaacaacatacctagtgatgagaaactagaagttttcctaacatcatgaacaaggcaaggatgtgccttctcaccactcctttttaatattatactggaagtcttagctagtgtaataaggcaaaaagggaaacaaaaggtaaacacattgggaaggaagaaataaaactctctttgttcacagatgtcattatcttatatgtagaagacccaagagaactgacaaaaacgctcctggaactagtaagtgattatagaaaggttgcaggatataaggttaatatacaaaagttaatcacttttccatataccagcagtcaacaaatagaatttggaattaaaaatacaataccatttatagtagtactctcaaaattcaattatttaggtataaatttaataaaatgtgtgaaaggtctatataaggaaaactacagaactctaaggaatgaaatcaaagaagaattaaataaatggagagctattgagtttcatggataggaagactcagtattgtcaaaatgtcagttcctcggagtatgatttatagattgatatgatccaagtcaaaatcccaggaagttattttgtggatattgacaaactgattccaaagtttatatagagaggcatgccaggcaccatggctcaagcctgtaatcccagcactttgggaggccaaggcaggcagatcacctgaggccaggagtttgagaccagcctggccaacatggcaaaaccctgtctctactgaaaatacaaaaattagttgggtgtggtggcgcacatccgtaatcccagctactcagaaggctaaggcatgagagtcacttgaacccaggaggcggaggttgcagtgagccaagagcacttcatgcactccagcctgggtgacagagcgagactctgtctcaaagaaacaaaacaaaataaagtttatatagagaagcaaaacattcagaatagccaacacaatattgaagtcaaaagttggacgactgatgctactcgacctcgagacttaatattagagctacagtaatcaagacagtatggtattggtcaacaaacagagaaatagaccaatgaaacagaacagagagtccagagatagacacacataaatatagtcaactggtctttgacaaagaagcaaaggcaatacaatggggtagacagtattttcaaaaaatggtgctgacaactagatttttaaaaaatgaatctagacatagacgttataccctccacaaaaattaactcaaaatagatcatagacctaaatagaaaatgcaaaagtataaaactagaagacaacaagagaaaacctggattaccttgggtatggcaatgactttttggatacaacaccaaagtagcgatccatgaaagaaataattgatgagctggacttcattaagatttagaaacttctggccgggcacggtggctcacgcctgtaatgccagcactttgggaggctgaggcaggcagatcacgaggtcaggagatcgagaccatcctggctaacatggtgaaaccccatcgccactaaaaatacaaaaaaattagctgggcgtggtgccgggcgcctcagctactagggaggctgaggcaggagaatggcgtgaaccagggaggcggaggttgcagtgagctgagatcgcgccaatgcactccagcctgggtgacagagcgagactctgtctcaaaaaataataataataataaagaaaaagatttagaaacttctgtgagtgaaaatgtcaagagaagacaagactgggagaaaaattttgtaaaagacatatctgataaaagatctatgcaaaatatacaaagaactcttaaaacttaacaattagaggccaggcgcagtggctcatgcctgtaatcccagcactttgggaggctgaggtgggcggatcacgagttcaggagatcgagaccatcctggccaacacagtgaaaccccgtctctactaaaaatacaaaaaaattagccaggcatggtggcaggcacctgtagtctcagctacttgggaggctgaggcaggagaatgggttgaacccgggaggcagagcttgcagtgagctgagattgcaccactgcactccagcctgggcaacagagcgagactccgtctcaaaaacaaacaaacaaacaaacaaacaagcaaaacactctgcaggatattatccaggagaacttccccaatctggcaaggcaggccaacattcagattcaggaaatacagagaatgccacaaagatactcctcgagaagagcaactccaagacacataattgtcagattcaccaaagttgaaatgaaggaaaaaatattaagggcagccagagagaaaggtcgggttacccacaaagggaagcccatcagactaacagcggatctctcgggagaaactcgataagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccactaccagccgctgcaaaatcatgccaaaatgtaaagaccatcaagactaggaagaaactgcatcaactaacgagcaaaataaccagctaacatcataatgacaggttcaaattcacacataacaatattaactttaaatgtaaatggactaaatgctccaattaaaagacacagactggcaaattggataaagagtcaagacccatcagtgtgttgtattcaggaaacccatctcacatgcagagacacacataggctcaaaatagaagcatggagaaagatctaccaagcaaatggaaaacaaaaaaaggcaggggttgcaatcctagtctctgataaaacagactttaaaccaacaaagatcaaaagagacaaagaaggccattacataatggtaaagggatcgattcaacaagaagagctaactatcctaaatatatatgcacccagtacaggagcacccagattcataaagcaagtcctgagtgacctacaaagagacttagactcccacacattaataatgggtgactttaatgggtgactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccgtacctattccaaaattgaccacatagttggaagtaaagctctcctcagcaaatgtaaaagaacagaaattataacaaactatctctcagaccacagtgcaatcaagctagaactcaggattaagaaactcactcaaaaccgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaaaagagacacaaaaaacccttcaaaaaattaatgaatcgagctggttttttgaaaagatcaacaagctagaccgctagcaagactaataaagaaaaaagagagaagaatcaaatagatgcaataaaaaatgataaaggggatatcaccaccgatcccacagaaatacaaactatcatcagagaatactacaaacacctctatgcaaataaactagaaaatctagaagaaatggataaattcctcgacacatacactctcccaagactaaaccaggaagaagttgaatctctgaatagaccaataacaggagctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgctgaacatcgatgcaaaaatcctcaaaatactggcaaaccgaatccagcagcacatcaaaaagcttatccgccatgatcaagtgggcttcatccctgggatgcaaggctggttcaatatacgcaaatcaataaatgtaatccagcatataaacagagccaaagacaaaaaccacgtgattatctcgatagatgcagaaaaggcctttgacaaaattcaacaacccttcatgctaaaagctctcaataaattaggtattgatggaacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacaacatgattgtatatctagaaaaccccattgtctcagcccaaaatctccttaagctgataagcaacttcagcagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcgatatcatgaaaatggccatactgcccaaggtaatttatagattcaatgccatccccatcaaactaccaatgactttcttcacagaattggaaaaaactactttaaagttcatatggaaccaaaaaagagcccgcatcgccaagtcaatcctaagccaaaagaacaaagctagaggcatcatgctacctgacttcaaactatactgcaaggctacagtaaccaaaacagcatggtactgataccaaaacagagatagagatcaatggaacagaacagagccctcagaaataacgccgcatatctacagctatctgatctttgacaaacctgagaaaaacaagcaatggggaaaggattccctatttaataaatgatgctgggaaaactggctagccatatgtagaaagctgaagctggatcccttccttacaccttatacaaaaatcaattcaagatggattaaagacttaaacgttagacctaaaaccataaaaaccctagaagaaaacctaggcattaccattcaggacataggcacgggcaaggacttcatgtctaaaacaccaaaagcaatggcaacaaaagccaaaattgacaaatgggatctagttaaactaaagagcttctgcacagcaaaagaaactaccatcagagtgaacaggcaacccacaaaatgggaaaaaatttttgcaacctgctcatctgacaaagggctaatatccagaatctacaatgaactcaaacaaatttacaagaaaaaaacaaacaaccccatcaaaaagtgggcgaaggacatgaacagacacttctcaaaagaagccatttatgcagccaaaaaacacatggaaaaatgctcaccatcactggccatcagagaaatgcaaatcaaaaccacaatgagatatcatctcacaccagttagaatggcagtcattaagaagtcaggaaacaacaggtgctggagaggatgtggagaaataggaacacttttacactgttggtgggactgtaaactagttcaaccattgtggaagcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaataatcattctcagtaaactatcgcaagaacaaaaaaccaaacaccgcatattctcactcataggtgggaattgaacaatgagaacacatggacacaggaaggggaacatcacactctggggactgttgtggggtggggggagcggggagggatagcattgggagatatacctaatgctagttgacgagttagtgggtgccgcgcaccagcatgtcacatgtatatgtatgtaactaacctgcacattgtgcacatgtaccctaaaacttaaaagtataataaaaataaataaataaataaaaacacacacttaacacttagaaaacaagctcggtatggtggctcacatctgtaatctcagcactttgggaggctgaggcaggtggattgcttgagcctaggagtttgagaccagcctgggcaatatgacaaaaccccatctctacccaaaatacaaaaaaattggacaggtgtggccgggcgcggtggctcacgcctgtaatcccagcactttgggaggctgaggcaggagaatggcatgaacccgggaggcggagcttgcagtgagccgagatcgcgccactgcactctagcctgggtgacagcgcaagactccatctcaaaaaaaaaactggacaagtgcggtggaccatgcctgtgttcccagctactcggaatgctgaggtggtaggattgcttgagcccagaaagcagagattgcagtgagccatgattacaccactgcactccagcctggggaaaagagtgagatcctgtctcaaaaaaaaaagaagagaaaagaaaacaacttgattaaaaaatggactgaaaacctaaacagacacctcaccaaagaaggcataaaaatggcaaacatatgaaaagatgcttcatatcatgtgttatcagggaaatctactacagtagattttggaccattctaataggccaagttccagcacactgaaaacaccaaatgctggcaaggacgtggaacaaaagcaatttttatgtgttgctggtgagaatgcaaaattgtcaactacttgggaaggtagttgggcagtttcttacaaaattaaacttactttgaccgtatgatcctgaaatcttactccttggtatctatcaaaaagagttaaaaacttgtatccacacagtagcctgcacataaatgtttatagaagctttattcgtaattgccaaaacttgaaaacaaccaagatattcttcagtaggtgagtggataaactgtggtacctttggacaatggaatattatttaccactgaaaggaaatgagatattaagacatgaaaagacttggagaaagctgggtgtggtaattcacacctgcagtcccagcacattgggaggccaaagttgacagatcgcttgagcccaggagttcaagatcagccttggcaacacagtgaaaccccatctctacagagaatacaaaaattagctgggtgtggtggtgtgtgactgtaatctcagctacccaggacgctgaggtgagataatcacctgagcctgggaagttgaggctgcagtgagctgtgactgcactccagcctggacaatggagtaagaacctgtgtcaaaaacaaaaaagacttgaaaaaaattaaatgcatattactaaatgaaaaaagccaatctgaaaaggctacatactgtataattacaactatagatattccggaataggaaaaactgtggagacactaaaatgcaattaaaaaattagtagttgcaaggggatggggtagagagagagaggatgaataggcagagcacagaggatttttagggcagtgaaatgctctgatactataatggggagacatgtcattatacatttgtccaaacccatagaatgtacaacaccaagaatgaaccctaatgtaaactagggaccttgggtgattacagtgtgccagtgtaagttcatcagttttaacaaatgtaccactttggtaggggatgttaataatcggggaggctatccatggccatgtatgggagcaggagatatttgggatatttttctatcttcctgtcagttttgttgtgaacttaaaactgctctaagtcttggccgagcgcggtggctcacgcctgtaatcccagcactttgggaggccgaggtgggtggatcacgaggtcaggagatcgcgaccaccctggctaacacagtgaaaccccatctctagtaaaaatacaaaaaattagctgggcgtggtggcgggcgcctgtagtcccagctacttgggagactgaggcaggagaatggcgtgaacccaggaggcggagcttgcagtgagcagagatcacgccgctgcactccagcctgggcaacagagcgagactccgtctcaaaaaaaaaaaaaaaaaacaaaacaaacaaaccacaaaactgctctaagtcttaaaaaacaattaaagagaggccaggctcatacctgtaatcccagcagtttgggaggctaaggcaggaggatcgcttgagtccaggagtttgagaccagtctggacaacataatatgagacagaaaaataccacaattagccatgcatggtggcatacgcctgtagtcccagctacttgggaggctgaagtgggaggatcacttgagcacaggggattgaggctgcagtgaaccatgatgacgccattgcactccaacttggtcaacagaacgcgaccctgtctcaaaaataaaaattaaaattaaagagaagtaattacagtgatgtgtgagaggaggaaaaaagataggaagattatgtcttaaggccaggtgcagtggctcacgcctgtaatccgaacagtttgggatgccgaggtgggagtattgcttgaggccaggaattcaaggttacagttcactataatcatgctacccgtactccattctgggcaacagaacaagaccctgtcaaagaaaaaaacaaaaacgttatgttttaaggaagcattgtggttaataatttatatttttggtagagattatttttctaaaagcactctcagaggaaaaaattaagctataaaaatttaaaaatcctaacaaattgccagtcttgatattaaaattataattaaaaatttttcttagatatcttataaaacagacattggcaaactaccaggtggccatttgttttaataaataaaattttactgaaacatagacatactcatttgtttatatattgcctatggttgcttttctgctagaacagcagaattgagtaaggcccacagcctgaaacacttactgtctggccctttttttttttttttttctgtctggccctttaagaaaaagtttttagatccctgttttaaaggacacaaatttgaatccttcctatagattaaaatttctactttgattatcatttcccttcagcctgaagaacttcctttagcatttcttgaagtgcaggtcttctagcagtgaatttttcaacttttatctgaaagtatctttattttattctcatttttgaaggttatttttgccagatatagaaatctgggctgatacgttgagggcattcatttagcatgttaaaagatgcagttccggcggggcgcagtggctcatgcctgtaatcccagcactttgggaggctgaggtgggtggatcatgaggtcaagagatccaagaccatcctggccaacatggtgaaaccccatctctactaaaaatacaaaaattagttgggcctggtggcgtgggcctgcagtcccagctactcgtgaggcttgggcaggagaattgcttgaacccaggaggtggaggttgcagtgagccgagaccacgccactgcatgccagcctggcgacggagactctgtctcaaaaaaaaaaaaaaaagatgcagttccaactgtcttctggccttcattgtttctaagtcagccatctttcttttgttgttctcttttattgtgtgttttttctctagatgcttttaagattttccctttatctttaattgttatcaatttgaccaagatatgccttagtatggggttttattttgtatttatcctgcttagggttctctgaggttcttagatttgtgggttgatgtttttcaccaaatttggggaaatttcagcatttattcagatcaaatatgcaaattttacaatgctatctttttttaatccttctaggactcaagtttcatacatttttaaaatttatttatttatttatttaagatggagtctcgctttgtcacccaggctggagtgcagtggcatgatatcggctcattgcaaccttcacctcccgggttcagtcgatcctcccacctaaaactcccaagtagctgggattacaggcatgcaccaccacgcccagctattttttttttttttttttttgtacttttattagagacggggtttcaccatgttggtcaggctggtcttgaactcctaacctcaagtgagccaccatgctcggccgagttacatacatttcagactgcttgatattatcccaaacatcactgaagttttgtttagatttttgtaataccttttctccttcagtttgtttaatgtctttgatttaccttcaagttcattgacccctttttttctgtaatgtttagtctgctgttaagcccagtcagcatatatttcactttagatgtcgtactttcaattccagaatttccatttggttcttttttactccccattctttaccagatgttcccacattttcctttaaatccttgaacatatatatacgcacacacatatatatacacatatacacacatatatatacatatacatatacatatatatataaacagttgtttataagttcttgtctgctaattttcacaagtggatcacctctccgtttgtttctgttgattcctttttttcttgattgtgggtcattctctgcttttttgtatgtctagtaattttattgtatactttatgagtattacattgaggagtttggattttgttgccttcttttaaagtgtgtcttcttttaaagggtgttgaattttgttctggcagacaaattactggaggagcctgcgttagggttccctagaggtacagaactaataggagatatatacatataataggatatattatatatatatatatatatatatatatatatatatatatatatatatatacccggctaccacacccggccacctctgttatttctgttcagctctcagccctatatcattttagatatgtgtgtgtatatatatatatatgtgtgtgtgtgtgtgtgtgtgtgtgtgtttgtatgtgtgtatatatatgtatatatgtacatatacattcttagatttgtggattgatgtttttcaccaaatgattcttcctcaaaaatgcctcccctgaccaaactatctaaaatagagcctcccaccactctctatcacatctccctgttttaatttatacacagcactctgacatttatattatgttctataacttttgtttatttattgttatctccccaacaagaatgtaagcttcgtaggacaataacttggtctgttttgttcactgctgaatctccagctgtttaaaacagttcttggcagggcacagtggctcacgcctgtaatcccagcactttggaaggccaaggcgggcggatcgagagatcaggagtttgagaccagcctgtatgtatatatatacatatacagcctgtatatgtatatatatacacacatatatatatgcatacacacacacacacacacacacacacacacatatatatataaaggggagtttattaagtattaataaagcctggatgacaaagcaagactccatcttaaataaataaataaaatttaaaatgtgtgtaacttgagtcctagaaggataaaaaaagatagaattttaaaatttgaataatatatgatctgaataaaggggagtttattaagtattaactcatacgatcacaaggtcccacattaggttgtctgcgagcttgaggagcaaggagagccagtccaagtctcaaaactaaagaatttggagtctgatgtttgagggcaggaagcatccagcacgagagaaagatgtaggctgttaagctaggccagtctcaccttttctcgtttttctgcctgttttatattcgctggtagttgattagaatttgcccatcagattaagggtgggtctgccttccccagcccactgactcaaatgttaatctcctttggcaacaccctcacagacatatccaggatcaatacttaaagtatctttcagtccagtgaagttgacactcaatactaaccatcacagagcctgttgattctgtcaggcttgtttatgctttggttttttgcttcattagagcaagttagtttttattttgtttttagtctcagagcatggcctttaactctagagtgtggcctaaaaatgataataatcataagtaattagtctagtgtggtgatgtgctcctatagtcccaactactcagaagggtgaggtgggaggatcatttgagctcaggagattgagactgcagtgagctatgatcatgccacagcacttcagcctgggcactagaacaaaccccaactctaagagcgtggtccctactcttaaactatggccttgtagcaactcatctgaataccgaagatggttggtgctccatgacctctgttatttcctttattttttatttttaatagggaagacggggagaattttagccttttttgtgtatgtgtgcagtggtgtgattgtagctcactgaagcatctacttcttgggctcaagctctcctcccacctttgcctctgagtatctgggactacaagtgtgtgccagcatgcccacctaatttttttaatttttagtagacacgaagtctcactatgttttacaggctggtctcaaattcctgagctcaagtgatctcccaccttggcctcccaaagcactgggattgcagggatgagctaccacacccaaccacctctgttatttctgttcagctctcagccctataggaggagctgtctgttagaccccatgaagtctcaccctgtgcatacacaacctggggcttggccaaagacctaagaggaaatccccatatagatttctgctctccgtttcatcccccacaggttcctcctctgtaatatcctttcctgcaaattctagccacctcagcaggccaaactctgatgatctctgtctcctctgctcacaaagactgcctattcatatatatcccttcttttaaggaccatggtcttgtgctgatggttgtacagtgcttacaaacagctgcctcatgtatttttcctgcctttataattgtttagggtagaggaaacccaatactggttagtatgtcattgctagcagtggaagttcatgttgtcctttttaaattaaataaatccatctctaagtttaaaggaaactcattactcacagaccatgtctcaggagccatatgagaacataattttaagtagtacatgtagacatttacctatatttcatggagggctgagatagtcccactaaccagtatttgagcaaatttcaagtgtgttgtatctgttcatatacacaaagcaaagaaagaatgttatatcgttgttttgtatttaatgtttatgtttcagaatgattaatattacttcatctctttctaggagtttttatggtcaattgctgatctgagtttcagtaactttccaaaacattactataagtaaatattcatcaggactctgaagtgcaagtcaactatataatcaggaggctcagaaaattgatcacagccggtcaataaattgattagttttacatgtaaattgtaaaactaatcagattttctcaatctaaatcttagattctctttcattctaaggataaatacattactttgacaactctaaatactccagtatgtattaatcaccaactatttgctaggcttgtctcataatccagaggaaaatattctcacttagtccccacattgatcatgcagggtaaatggcatcatctttattttatagatgagggttgaggcttagaaaaattaggaactaatccaaagtcatgcagttaataaattacagagccatgatttgactctctaaaagagaaaatctggtctaactccaaagctcatgtattttattcttttattctcttggctgtgcagtagaaccacctttggagctttcagtaaatatagaaacccatgccccattcccatgttcagtacgtctgtggtagtgtctgtaatattagaatgcagccagagttgaggaccactgcttatcagtgccatactccttctctatagccataggcactggatcatgaagtcctgttagtcaggaaattggaagtctagacagttttgagattatagccctgctgttagagtaagaaaatgggaggaaaaggcaggatcagttctttttttgcctctcagagtaggggctgcaactgaagcctaaaagagaagtagaggacgattaatcctaaaccacctgtcatctttgtaagcatcttaccagtttctttagaaatgtttactctgaatttttaagtcaagtgagaggtatgtcttatctctactgtcatgagctttttgtttcctcacctttgaaaaagggatatctatctaatttagaggtaagggtgacatgagactagtgcctggttattgcctccttaggagctaccagatacagtcccagcccccagttacctctgccacctagccacctattcttaaagtttttactattgtgtctctaatatggccccttctttcctgtctccctcatttctaacactttttcctcactccttagcttctcctcaaatatgctgcgcatgctcctgtctcaaggcctttgtacttgctcgtctttgtttgaatgttcttcctccaagtttcattcatacctctgctcaaatgattcctcctcaaaaatgcctcccctgaccaaactatctaaaatagagcctcccaccactctctatcacatctccctgttttaatttatacacagaactctgacatttatattatgttctataacttttgtttatttattcttatctccccaacaagaatgtaagcttcataggacaataacttggtctattttgttcactgctgaatctccagctgtttaaaacagttctgggcggccgggcacggtggctcacgcctgtaatcccagcactttgggaggccgaggcgggcgaatcacgaggtcaggagatggagaccatcctggctaacacggtgaaaccccgtctctactaaaaatacaaaaaattagccgggcgcagtggcgggcgcctgtagtcccagctactcgggaggctgaggcaggagaatggcgtgaacccgggaggcggagcttgcagtgagccgagttcgtgccactgcactccagcctgggcgacagagcgagactccgtctcaaaaaaaaaacagttttggcagggcacagtggctcgcacctgtaatcccagcactttggaaggccgaggcaggcgaatcaagagatcaggagtttgagaccagcctagccaacatggtgaaaccctgtctctactaaaaatacaaaaattagccgggcgcggtggcgggcgcctgtaattccagcttctcaggaggttaaggcaagagaattgcttgaacccaggaggtggaggttgcagtgagccgagatcgtgccactgcactccaacctggctgacacagcaagactccatcttgaaaaaacaaaacaaaacaaaaaaacagatcttggcatatagtagatactaaatattatccaattggctgggtgcgatggctcacacctataatcccagcactttgggaggctaagatgggcgaatcacttgaggtcaggaattcgagaccagcctggccaacatggtgaaaccctgtttctactaaaaatgcaaaaattagctgggcatggtggtgcacacctgtaatcccagctacttgggaggctgaggcacaagaattgcttgaacccacggggctgaggttgcagggagctgagatcacgtcacttcattctagcctgggcaacagagcaagactcagtctcaaaaataaataaataaatatataaataaatattgtcaaatgattaaatttctacactgataactctgctttataaataatacaaaaatcagtgataggataaaaactatatgctctaatggctttggtggcctgtattttctctttgtgataaatacattttattattttatctttgatacttttccttaataatggctttatcaatgatatatgttttagcagctgtagtggtcggatcttgcattgctataaagaattacctgaggccaggcacgatggttcacgcctgtaatcccagcactttccaaggtcaaggtgggaggatcacttgagctcaagagttcaagaccagcctgggcaatatagtgagaccccatctttgtttttgttttaaatgtttaaaagaaaaaaaaaattaccagagactgggtaatttataaagaaagaggtttaatcagctcatggttctgcgggctgtacaggcatctgcttctgaggaggcctcaggacacttgcaatcatggcataaggcgaaggggaagcaagcacatcttcacatggccggagaaggaggaagaaagcaaaggggaaggtgccatacacttttaaacaactagatcctgtgagaactctatcacgagacagcactatggggatggtgctaaaccattagaaaccacctccatgatccagtcacctctcaccaggccccacctccgacactggggattacaattcagcatgagatttgggtggggatacagagctaaaccatatcagcagcctagctattaatggtattttctgatagcagcatgatattccctgttgacttgtatatttttcccctggctctctggtcttcaatgaagaggaccgggttaaaatataaagagagctgctttatttatttatatttatttatttatttttgagacagagtctccctccattgcccaggctagagtgcagtggtgctatctcggctcactgcaacctcctccacctcctgggttcaagcgattctcctgcctcagcctcctgaatagctgggattacaggcacacaccattatacccggctaatttttgtattgttagtagagacggggtttcgccatgttggccaggctggtttcaaactcctgacctcgtgatccgcccacctcagcctcccaaagtgctgagattacacgcatgagccaccccacctgaccgagagttgctttgatatcaatcattgtcatgatattgtttgcagtctactctgcatctaattttccccaaactttcattgtttttaagctcacatttgttacaggttttttcttaatttgtttgagaagtattcttaatttgtttgacttagtactttcttatctgaagatttataggctgggcacagtggctcatgcctataatcccagcactttgggaggccaggacaggaagatggctggagcctgggagttccaagaccagtctggacaacatagtgagacctcctctctacaaaaaaaaattttttaattagccaggtgtagtgttgcatgcctgtagtcccagctagtcaggaggttgaggtgggaggactgcttgagccccggaggtcggggctccagtcagctgtgatcacactggtgcactccagcctgagtaacacagcaagacttctcaaaaaaattaaaaaaatgaatgcttatcataaatggtttataatgataaattaaaaaccatggaaatcttatagggagggttcattaaatttgttatatccataaaagtgtaatatgtagccactaaaaaggatgatgctgagctatatttattggcatacaaagatatatatgttgggccggatgtggtggctcacgcctgtaatcccagcactttgggaggccgaggtgggcggatcacctgaggtcaggagttcgagaccagtctgacccacatggagaaaccccatctctactaaaaatacaaaattagctgggcttggcgcatgcctataatcccagctacttgggacggctgaggcaggagaatcgcttgaaccggggaggcggaggttgtggtgagccgagatcgcgccattgcactccagcctgggcaacaagagcaaaactccgtctcaaaaaacaaaacaaaacaaaacaaaaaacaaagatacctatgttgtttcttgtttttaagacagtgtttccctctgtcacccaggctggagtgcagtggtggctcactgcagccctagcctcctgggctcaagtgatcctcccatctcagcctcctgagtagctggattacagatgtgtgccaccccacccagctaattgtatttacttttagtagagacagagtcttgctaggtacccctgggctcaaatgatcttcctgccttggcctcctaaaatattgggattacagacatgagacactgtgctcaatctgtatctgtgattttttaaattaaaaagaaaacaggttacaagaaaacaagtataacataatctcatttttgtggaggaaaaaaatagatacttgtatatgtatacacaagtatctcctatacaaaattggagggtaaggttagcactcttaattgtctccaagtcagctagcatttttctagatcatcgtttgtttcagtacgactaactataataattacctctttttttaatttttaattttttaggtatatagtaggtgtggggcttataactattacttctggcctctgggaagccctctaactattctatcctaggtataaataaatacctttctccttagttcaacaaaaccaaggctggggttttctaaaaggaatttttcaagaaaacaaaaaaaggaaagtaaacaaaaggcaaaataaaagcatagaaatcaaagtgtttacaggatacacactgctttttcttatgtcagtaaaagtctatccaccaactagttaagttgttacagtttatggggctctaaagtttttgggagctgggcatgatggctcacgtctataatcccagcagtttgggaggccaaggtgggacaattgcttgaggccaggagtttgagaccagcccggaccacatagtaagacctcgtctctacaaaaaataaaatattagccaagtgtagtagtgcaagcctgtggtcccagctacttgggaggctgagctgggaggatcacttgagcccaggaagttgaagttgcagtgagtgatgattttgccattgccttccagcttgggcaacagaacaaaaccctgtctcagaaaataaaaaataaaaataatccttgtgactctgcaacccaggctggagtgcagtgccgcggccttggctcattgcaacctccacctcccaggttctagcaattctggtgcctcaggcccccaagtagctggggttacaggcgtgtgccaccacgccaggctgaattttttgtattttttagtagagatggggttttgctgttttggccaggctggtctcaaacttctggccacaagtgactcacatgcctcggtctttcaaagtgctggaattacaggcgtgagccacctttcctggccccttgtggcaattttttacccagatctctctagccaaaactataaaattgagagttttgattcagcactatcatttggtaataatgtagagaaaaatggaatgacgtggaaaatatgtgtaaaatacaaataaaaaagattataagatagtatatatgatataaccctaattttaaggtatacagtataatgtacagaaataaaaaaaaacccaccagagagatactcttcagatgataacagtggttatctttaagttgtagtactacagttaaagtttaatttctttgtgcttttctatttttccaagttttctataggaacatgttattaagaagtatatatatatattttttaaattatttatttatttatttatttatttatttttttgagacggagtcttgctctgtcacccaggctggagtgcagtggtgtgacctcggctcactgcaagctctgcgtcccgggttcacgccattctcctgcctcagcctcccaagtagctgggactacaggtgcccgccaccacgcccggctaatttttatttttttgtatttttaatagagacggggtttcacgatgttagccaggttggtttcgatttcctgacctcgtgagccgcccgcctcggctgcccaaagtgctggaattataggcgtgagccaccgcgccaggactttttttttttttttttttgagatagagttttcactcttatcgcccaggccgcagtgcagtggcctgatctcagctcactgcaacctccacctcccaggttcaagagattcttctgtctcagcctcctaagtagctgggattacagacacgcaccaccatgcccggctaattttttgtatttttagtagagatggggtttcaccttgttggccaagctgggcgacagagcaagactctgtctcaaaataagtaaataaaagaaaagaaaagaaaatttgagcaactaaaaataacatattcttaataccttacctaacttgtgtcaatttttatttgtgctatgcatataaaaaggtctcactgttgaagatcactgtatctgaagagattcattttatttatttatttatttgagatgaagtctctgtcacccaggttgcagtgcaatggcgcgatctcagctcactgcaacttccgcctcccagattcaagtgattctcctatctcagcctcctaagtagctgggattatagacacgcaccaccacgcccggctaattttttgtatttttagtagagatggggtttcaccttgttggccaagctgatcttgaactcctgaccttgtgatctgcccacctcaacttcccaaagtgctgggattacaggcgtgagccactgcgcccagtccattttattaattcatcaaatctttgttgaacttctcttacatgctaggcatgttctagatgttggggatatagtggtgacgaagacagtttgtactgtcatggagcttatattctgggcagatttattggtcaaaaaaatctgtgatggggccgggcgcggcggctcacacctataatcccagcactttgggaggctgagggaagcagatcacctgagatccagggttcgagaccagcctggccaacatggcgaaaccccatctctactgaaaataaaaaacttacccgggcgtggtggcgagcgcctataatcctagctattacggaggctgaggcagggagaatcgctggaacgcgggaggcagaggttgcagtgagttgagatcatgccattgcactccagcctgggagacagggcaagactctgtccccccaccaaaaaaaaaaattctgtgatgaatggtacagtgtatcaattagtaactgtaaataaattagcataccaactataaggattacaaaattagaataaacatcatagaattagtgcaatgtaaattgattcacggtggttttttttttttttttttttagaaatcatagtatcaatgggaataatatggatttattttttttcttctagctttaaggaagcctcctatttcagtttctcaacatgaaagtcatcaagcaatctcccatcttccaactggacaacctctctccccaaatatgcctccaggtatgaaggcttatgcttataattccatttgaaaccaacttactagtcatgtacagttatatagtgtataaaatatatcacttagcagtatagtgaaatagcatttattctttgaggtaatgttatttttttttagactagtaaaagcagagagaaataataatctgaaactccactttatctggtggattgttagtctttttcttaagaacagaagaattatttattatgccactctgagctacattccctttcctctctgcctgctatacaggtttagcttcttcaaaatgtgttcaaatttatctcatagaggccttctataaattacagtgcccacctatattaaaatcttcgtacttatgaatgtatttgtttattttctaaacactcattccattttatagaacatttccctgaaatgagagtagatatgattgaagagacctgcttaagggagatgatggaaaggaaaaaggtcagagtggaataggatgttttgggatccaaaattaaagtcattgatgaggataaaaagggaggtggggaaagagaggtggtatccagtagataatgctaagaaagaatcaagagtcaacacttgtgagtcactgtatagtgaagatgacttagagagtagaaatttcaaaagccttactggattttggagatttctgatagtgatatggaatttggagggaggaaaagatatgagtatcattgctatattaatctatggatttctactgtatatctttttggtgaataagtttatggccattagtggagatactcacctgggaatgatcagtaaacttcccacagctaaaatcacattggttataatacttgattaaagaaatgagaataaacctttaaaaaaaaaaaaaaaagctttgtggctacccaatgttaaacaatagtgtgtcttagctttctaaagcagatcttgtgaaattcatctttaaaagattaaattaaattatattcttttaatttgatgtttttatgccacagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagtaagaatcaattgatgaatattatgctaaaaatatttctttaaatgtaatatgaattaaggtcttcattattctgctctctaataaatgtatagtgaagttatatatatttaaagagaaggtatgaaagtgtcaaaatttaaaggaaatacaggttttaaatggatagatacgattttaaagaaaactttaaaaaggttctcatgttctccattgttaaataataaatttcaggtgagttgactttttttaaaaatacaattagttcttatgaatataaacttttttggagaaatgagaaaaatatattttgataggcttacaaatgaaaactttgattagggaggagagaaaataaatagttttgaaaaatggaacattctgggagaaacatacactctgggggattgccttagtagattgctcaatactgcttcctcctccattccctgcaattgcattttcctcatttagatgttagaagtataagaaaaaattctagtagtagaatttgaggcaggagagtgtcccttagatcagcttccttaaactgtgcttttcactggttctgcttttcatggcatcttcttaccttcaattctgaatagacagaatctctaaaagcttcagtttgtctttggtttatttatttatttttaatttttatcagtcaccaggagtaagatcaagtctttggtttttatgatggcttctgtctatggcagcaactgtgcagagcactggttaggcagttatttgtacaaagattgcgtgtaagctaataattgaacaatgttatatttgtgaatttattcaaggtattttattttatttctttatttttatttatttatttttagagacgggggtctcgctttgttgcccaggctggtcttgaactcctgggctgaagtgatcctcccgccttagcctcacaaagtgctgggattacaggcgtgattcactgtgcccagcctattcaaggtatttttgttgatcttgtaacagttattcaaatttattcatatatgtgaatgtatagtttgcattaatttaattggctttcctttcttttttctttttttctgttttcttcaaataggaaattccttgatattttaaagcatatctgtgtatcttgaccaaagtattgtgtgaaaaacatttttattacaaagatttagctaacattttaaatataatgaaaaaatatttcctcaaaattgggttgggggattggcctgaaaacttacatctcaacaagaagaggtgtacagtaagagcataacaaataaaatatcttaatttgatcacttaagattttcttcttttttttttaaattttttttgagatggagtctcactctgtcacccaggccaggagtgcagtggcaggcaggagtgcagtggtgcaatctcagctcactgcaacctccgcctcccaggttcaagcgattcttctgcctcatcttcctgagcagctgggattacaggtccacatcaccatgcctggctaatttttgtatttttagtagagatagggtttcaccgtgttggccaggctagtctcgatcttctgacctcaggtgatccgcccgcctcggcctcccaaagtgctgggattacagtcatgaactactgctcccggccaagattttcttctaaacttatatttattctatacatttttttaattgttgccttacctgtatatatttttttaactgatatttgggtaaagaaggtggttggaaataattgctcggaaattattactctctacaataattttgaaaagagcctaggcatggtggtacacaactgtagtcccagctacttgagaggctgaggcaggagaatcacttgaacccgggaggcgaagtttgcagtgagccaagattgtgccactgcactccagcctgggcaacagagcgagactctgtcaaaaaaaaaaaaaaaaaagaaaagagcctattgagttttaaaccctcactccatattattttccatttatcattaatgtatatggagagttgaaatcaatgcatgcacaattttgtgatttactttgacattatttcttacattcctttttacttaatttaaatttttattaatatatacacatatattctgtatatattatatacatatacagaatatatgtatacatatacatatattctattgtgcttaggcaataataacagtttacttaggtctcctctcattgtttagatcatttcgtattttctcattgtagctgtcatgattgttactatcattttttttctccagttatttcctgttcttcctactttgcgtgttcctttaaaagtatagtcctcagaacgaaattactgggtcaaagcacttgactagctttatagcacttgttaaatagtgtcagattgttctctagaacagttttaaagtgtcactggagttatttaagtttaggggtttctctgtggcctggccacattgatttttatcgtttttataaggtatttagaatataacgtttccttaaaaatgttttaataatcatttattctggtggcctatatttatgtgagtaattttattataattatttcttggtatataatctgtgcatcagttttgaccacttagcctgaaaactttgtagatttgttctatttatttgtatcaactcttttctttttctttttttcttttttttttttttttttgagacaacgtctcactctatcacccaggcttggagtgcagtggtgcagttgtggctcactgcagccttgacttcctgggttcaaatgatcctcccttctcaccttcctcagtagctgagaccacaggcatgtgccatcacacctggctaatttttaaaatttttaaacaaaaatgaggtctcgttctgttgtccagactggtattgaactcctgtgctcatgtgatcctcccatctcagcctcccaaaatgctgggattacaagcgtgagccaccattgcccagccccgtatcaaatctttatagataattcagatttatcacagttttcctcttatattgtcgttcctgatataagactttcttatgctttatcatgcaaaagtttttttaattaaaaataattttttgttttggtaagttacacgtaaaattcaccaaaatgtacaattcagtggcatttagtgcattcacaaagttgtacaaactatcaccactctagttccagaatattttcatcaccctgaaacaaaactctgtactctcctaccctcagcacctggcaaccgctaatttgcttttttctctctgtctatggagtcaccaattctggatatttcatataaaaggaatcatacggccaggcgcggtggctcatgcctgtaatctcagtactttggaaggctgaggtgggtggatcacaaggtcaggagatcgagaccatcctggccaacatggtgaaatcccatctctactaaaagtacaaaaattaggccgggcacggtgactcaagcctgtaatcccagcactttgggaggctgaggcgggcagatcacgaggtcaggagtttgagaccatcctggctaacatactgaaaccctgtctctactaaaaatacaaaaaaattagccgggcgtggtggcgggcgcctgtagtcccagctacttgggaggctgaggcaggagaatggtgtgaacccaggaggcagagcttgcagtgagccaagatcgcgccactgcactccagcctgggcgacagagcgagactccatctcaaaaaaaaaaaaattagctgggcgtggtggcgcatgcctgtaatccaagctacttgggagggtgaggcaggagaatcacttgaaccagggagttggaggttgcagtgagctgaggtcacgccactgcactccagcctggcaacagagcgagactgcatcttaaaaaaaaaaaaaaaaatcatacagtatgtgaccttttgtgtctggcttcttttatttagcataatttttctgaagttcgaccatgctgtagcatgtagcatctatcagtattttatttctttttatggctggataatattcagttgtatggatacattttgtttattcatctgttgatgtatatatgggttgtttctatattttggctatcgaatagtgcttctatgaacatttatgtacaagtttttttgaacatctgtttttaattctttgggtatgtacctagatgtgaaactgctgagtcatatgatagttctatgtttagctttttgaggaactgccaaaccattttccacaatagctgtaccattttacattcccaccagcaacgtataagagttccaatttctccacatcccctccctccctcccttcctccctccctccctcccttcctcccttccttccttccccccgccactttcattcattccttctaccatgtagtacatatgaagtgatgtttccttgtggtttttatttgcatttcactaatgacattgagcaccttttctgtgtactttctggccatttgtatatcatctttggagaattgttctttcaagacctttgtccttttttaaaatttacttttagagacagaatctagctttgtcacccaggccagagtgcagtggcacagtcatagctcactgcagcctcaaactcctaggctcaagtaatcctcctgcctcagcctcagtagtagctatggctacaggcataccctaccatgtctggctagtgtatgtatttattttttagcttttgtggagatggggtcttgctgtcttgccctggctggtctccaactcctggcctcaaacaatcctcccatcttggcctcccaaaagcactgggattataggtatgagccactgggcctggccctttgcccatttttatgttgggttatttgtcttggttgttgagttttaagaggtttttgaaaaggtattctggttactagaccctaatcaggtgtatgatttgcaaatatttttgcacagtctatgggttgtcttttcattcttgatagtgtcctttcatgcacgaaagtttttaattttgatgaggtccaatttatctattttttgtttttgttcatactttgagtatcatatctaagaaaccagtgccaaaatcatggtaatgaagatttccccctgtgttttcttctaagactttcataggtttagctgttatatttaggtctttcatccatttaaagttagtttttgtatatggtttgaggtaaggtctaacataatccttttgtgtgtggataccagttgtcccagcaacatttattgaaaagactcttcatttcccattgaacaatcttggtatccttgtcaaaaatctattgaccacagatatatgggtttatttctgaattataagttctgttacatttatctatatgtctctccttatgccagtatcatactgttttcattgctataactttgtagtaagttttgaaattgtgaattatgagtccttcaactttgttcatctttaagattattttagctcttcatgatcccttgtaattttattgtaggatctgcttttccatttctactaaaaaggcagcgatattttaaaaggaattgtggctaggcacagtagctcacacctataattccagcattttgtggggccaaggcaggaggatcacatgaggccaggagttcaagaccagcctgggcaacgtagcaagaccctatctctaaaaaaaatttaaaaattagccaggcatggtggcacaagcctgtagcctctgctactgtggatgctgaggtgggaggattgcttgagcccaggagttcaaggttatggtgagctatgattgttccactgcactccagcttgggtgacaaagtgagccctgtctctgaaaaaataaaattaaaaaattggccgagtgcggtggctcatgcctgtaatcccagcactttgggaggccgaggcaggcagatcactggagcccaggagtttgataccagcctgggcaacatggcaaaaccctgtctctacaaaaaatacaaaaactacccacatatggtggcatgcacctgtagtccccgttacttgggaagctgaggtgggaggatcacttgagcccaggaggcagaggctgcagggagctgagattctgagattgtgccattgcattccagattgggcagcagagcaagaccttgtctggaaaaaaaaaaaaaaaaaaaaaggaattgcactgaatctgtagatcactttggagagcactgccatcttaacaatatgaggtctttcaatccataaatatgggatgtctttccatttatttaggtcatctttaattcctttcagcaatgttttgtagcttttagtgcacaagtcttgtgctgccttggttaaatttattcctaagcattttattgttttgatgtcattgtaaatcgaactgttttcttaattttccttttagacttcttgctagtgcatataaatatgactgatttttggcctggcctgatggctcatgcctgtaatcccagcattttcggagaccgaggtgggtggatcatctgaggtcaggagttcgacaccagcctggccaacatggtgaaaccccatctctactaaaatacaaaaattagccgggtgcagtggcaaatgcctgtaatcccagctacttgggaggctgagacatgaaaatcgcttgcaccaggaggtggaggttgcagtgagccaagatcgcgatactgtactccagcctgggtgacagaatgagacactctctcaaggaaaaaaaaaaaaagaaataagactgatttttgtgtgtgttgatcttgtatcatgcagctttatacaacttgacacaaaaggtctttatttgtatatattcaagcatattgatctagactcttatgatgattttcatttctcttatagaagatcatttcttttataaaaatcatttcttttattctatctggacataaatatactgttcttttttttgtttttgagacggagtcttgctctgttggccaggctggagtgcagtggcgcaatctcagctgactagaacctctgcctcctgggttcaagtgattctcccacctggccaatatggtaaaaccccatctctactaaaaatacaaaaattagctgggcttgttggtgcatgcctgtaattccagctactcgggaggctgaggcacaataatcttgaacctgggaggcggaggttgcagtaagccaagattgcgccactgtactccagcctgggcaacagagcaagaccctgtctcaaaaaaaaaaaaaaaaaaatcgttagtattcttgtgtttattcagctttgctttccatagagtaaaaactatttagttataagaaaaatttattttattttagttatttaagagacaggtggcctggcacagtggcccatgcctgtaatcctaacactgggaggccgaggcagatggatcacttgagcccaggagttcaagaccagcctaggcaacatggtgaaaccccgtctctacaaaagatacaaaaattagctgggcatggaggcgtgctcctgtagccccacctccttgggtggctgagttagcaggattctttaagcccaggagttagaggctgcagtaagccatgatcgtgccactgcactccagcctgggcaacaaagcaagaccttgtctcaaaagaaaaaaagagagagggagagagacagggtcttgctgtgctgccgggctggattcaaactcctgggctcaaatcatcctcctgccttagcctcttgagtagctgggatttataggcatgcatcactgagcccaatgaaaattcatttttttttttttagacggagtctcggtctgtcgcccgtgctggagtgcagtggcgtgatcttggctcactgcaagctccgcctcccgggttcacgccattctcctgcctcagcctcccaagtagctgggactacagacgcctgccaccacgcccggctaattttttgtatttttttagtagagacggggtttcactatgttagccaggatagtcttgatctcctgacctcgtgatctgcctgcctcggcctcccaaaatgctgagattacaggcgtgagccaccacgtccagcttgaaaattcatttttaagtacagttttgctttatagttttcttcttttttgacttacaatttttttctttcatttaacacttgtcaaatcattatttgtatctaaatcattattctcaaaaatttcattgtggccgggcacagtggcacacgcctgtaatcccagcacttttggaggctgaggcaggtggatcacttgaggccaggagttcgagagcagcctggccaacatggcagaaccctgtctctactgaaaatacaaaattacccaggtgtggtggtacacgcctgcagtctcagctactcaggaggctgagtgggaggattgcttcaatctgggaagcagaggttgcagtgagccatgatcacgccactgcactccagcttagacaacagagtgagaccctgtctcaaataaataaataagtaaataaaaaataaaagcacttgatactctgtaggtacaaaataacatgctgttagaaaaaagttgaaaattttattgaaaacactattagaaaaggaggggaagtccttagactttatatagttatcaccacaatttttgttttgttttgttttttgagacagggtctcactctctcacccaggttgtactgcattagcacgttcatagctcactacaaccttgacctccttgggctcaagggatcatcctacctcagcctcctgaatagctgggactacaggtgtgtgccaccatgcctggctaatttttgtatttttgcagagacagtttcaccatgttgctcaggctggtttcaaactcctgagctcaagcagtcctcccacctcagtgtcccaaagtgctgggactacaggcatgagccaccattcctgacctcactacaaattttttggcagctttaactttagtatttttgttttatagcttaatatatcatacttatattgatatatttataaagagctgcatatttttgtaaatttaattttgtattaccacatcatgcaaaagtggctagaacattttggggtatatttcaccatatttggaagatgtatttgggttagtttaatttaaactttagaatgtaggctatgtggtgacacaaaatatagtttagggatacttcaaagaaacagacatcttccaaaatagttgaaactgaaaatccaggcgaggcctacatgtttgccagctaggagggacataccatttgtatttagatgctttgaatagagataagaatttacttcaaatgtcagctcccatatggaaagtcatgagggtggttactccaaacagtagggagtgattgttgatcaaattgcttctcatattggcttttctgtatagcagcagggtttcatttatttaacagtggttattaatcattctcccaaggaacactggagaggcaagctagtgtatcacagaatacctgatcttcctttacatatagaatttttttttttttttttgagatggagtttcactcttgttgcccaggctggagtgcaatggcacgatctcggctcacccaccgcaacctccacctcccaggttcaagtgattctcctgcctcagcctcccaagtaactgggattacaggcatgcaccaccacgcccggctaatgttatatttttagtagagacggggtttctccatgttggtcgggctggtctcgtactcctaacctcaggtgatccgcccgcctcagcctcccaaagtgctgggattacaggcatgagccaccatgctcagcccccttttctaaggtccctcatcccatttataagagtggagccctaatggcctaatcacctcccaaaggccccatctcttaatatcaccacagtagggattaagctgcaacatgaattttggagaggacacattcaaactgtggcaattattagttacctaaattggctcatgaagatttgaaaacttgaataaaccaataatcattaaataagttgaataggtatcaaaagttccccccttccctcaaaagagactggtaaaagttaatgagagtttagcttgattactaattcagggtcactgtatgaaatcaagcaaaccaaaaactggttctttgaaaaggcaagtgaaattggaaagaccagccaggtgtggtggctcacacctgtaatcccagcactttgggaggctgaggcgggcagatcacgaggtcgggagatcgagaccatcctggctaacacggtgaagccccgtctctactaaaaaaaatacaaaaaattagccggtcgtggtggcgggcgcctgtagtcccagctacttgggaggctgaggcaggagaatggcgtgaacccgggaggtggaggttgcagtgagccaagattgcgccactgtactccagcctgggcgacaaagtgagactccatctcaaaaaaaaaaaaagaaattggaaagatcgtcagcacacattaagacaggaagagatgacacaaattctcaataacaaaaatgaaaaaaaaagaacatcaatatagatcctacaaataatattaaaggacacatgataagaggtattattaatttaatgccaaaacatttgcaaagttagatgaaatggccaatgtcctagaaaaacacttctatacaaaactgacagaaaaagatagggaaaatctgaatagttccatgtctattaacatattgaatctgtaagttaatattttggtacctaaatggtttcattgatgaattctttattttttatttatttatttatttttgagatggagttttgctcttgttgcccaggctggagtgcaatggcacaatctcagctcaccgcaacctctgcctcccaggttcaagctattctcctgcctcagcctcccgagtagctgggattacaggcacgtgccaccatgccctgctaattttgtatttttagtagagacagggtttctccatgttggtcaggctggtcttgaactcccaacctcaggtgatgctcctggcttggcctcccaaagtgctgggattacaggtgtgagccaccgcacccagctggtgaattctttcaaacatgaaagaatacaaccaatgtaacataaactttcagagaattgaaaaggaaaaaaacactccccaacccattttatgagaccagcataagttggacagcaaaactaagaatattatgagaaagaaaaattatagcagtttctcttattaatatagatataaaaatcctaaacaaggccaggcacgtagctcacgcctgtaaatcccagcactttgggaggccaaggcaggtggatcacctgaggtcaggagtttgagaccagcctggtcaacatggtgaaaccctgtctctactaaaaatacaaaaattagctgggtgcggtggtgcgcacatatagtaccagctacttaggaggctgaggctggagaatcgcttgaacccgggaggcggaggttgcagtgagccaagattgtgccactgcactccagcctggtgacaaagcgagactcggtctcaaaaaaaaaaaaaaaaattctgaacaaaacattagcaagtcaaatccagagatagataaaaattatatacatgatgaccatgttggatttaatctgaaaattcaagattgtttaatatttgaaaagcgatctatgtaatttaccacattaacaaaatatatgaggaaaatcatctcaaaagatgtaaagtgagcatttgaggaaattcatgcatttatgataaaacaaccaattttaagcaaagtagggttagaaagtaatttccttaactcgatagagtattttaagcatcctatgacaaatatcaaatttaatgattaattctcaaaaaccttcccttgagatctagaaaaggatacccaccatcatcacttctattccgcttttcactgtagattctaatcaatgaaataaagcacagaaaaggaaataaagagtatagagattggaaaggaagaaatataactgataagctgatattatttgtagacaatatgattttatatgtagaaaactcaaaacaatttataaacaaatgtatttagcaaagttattacatgcaagatttatatacaaattatatttctgtatatagcagcagtaaacatagtgaaacttttaaaaagaaactttttaatagcataaaaagacatcagataccttgaaaagttcttacaaagatttacaagaacctctataagctacaaaatattgttcacagaaattaattaatatataaataaatccatatccatggattggaatgctcaatgttgtaattatgtcaattcctcccatattaatctagaacttcattgccatcccaattataatcccagcagagtttgggggttttgggtggaatctgataagctgactctaaaatgtgtatggaaactgcaaaggaataagaatagccaagacaatttataaaaggaataaagtgtaaagacttccactatcagatatgaagatttattataatgctctttttttgtttgtttgtttgtttgttttgagacacagtctcgctgtattgcctaagctggaatgcagtggcgtgatctcagctcactgcagcctctgcctcccacattcaagcgtttgtcgcccaggctggagtgcagtggcgcaatcttggctcactgcaatctccacctcacaggttcaaatgattctcctccctcagcctcctgagtagctgagattacaggtgcatgccacaacacccagctagtttttgtatttttagttagagatgaggtttcactatgttggccaggctggtctcaaactcctgacctcaagtgatccacccgcctcagcctcccaaagtgctaggattacaggcatgagccaccgtgcccgacctactgtgctattttatacaagggactttaacatctgtggattttggtatctgctggggtcctggaacaagttctcagtggatactgagggaggaacaactctattcaccataaatcactttgtaggataaattgacctcatcagactggtacataatggctcaggcctcaggcatacaaaaacatttataaagcagaatatttcatgggctcagaggttatctctcagaatccagccaagggccagtcctgaaaacaaagctttctttggaatgtacagggtttgagcaaccacggaatacattgcatcacaacaggggatacattctgagaaaggtggtttttagttgatttcatcattgcgaacatcatagagtgtatctacacaaatctagatagtataggtttgccttggaaacggggagatggtaaggttgttcagatgctgtttgccataaattctagctaccatgcttctttcatttcctttatttctctttaccttccacaagtccagtccatcagtgaatagattgcttcctgtgcctactatatgcagggcctatatcccttgagatagaaatgtggtctttttgccctaatatgttcctgataatgaaatcaattcaaaagccagtcaatagttttcctacaattgttttgtgaagaaagcctgcagtaacatttttgttacagtttgtacaccccaacctcccacctctcatgattataactcatatctcaacagattataagtcatcacgtgtcatttaccttcagggtacttgaaatagtcacaactctaggtattaaattgaataatgcaagatcagttgaatgtgttaactaccaaatgaataaatgaaagtgaatactgccaatagatgaaggctagaaaaaagaggctgccttccttaaactttccttttcattctctctaggtttattgtaactagctctaatagtttcattttgcttacaatagtggtaatatattacattaatgacataaaaatataaacttttttttttttttgagacggagtctcgctctgttgcccaggccagagtgcagtggtgcaatcttggctcactgcaacctccacctcccaggttcacgccattcttctgcctcagcctctccaaggagctgggactacaggcgcccgccaccacgcccggctaattttttttttttttttctgtttttagtagagacagggtttcactgtggtctcgatttcctgacctcgtgatccgcccgcctcagcctcccaaagtgctggtattacaagcgtgagccactgcgcccggccaaaatataaacttttaaaaataaaatagttgagaaattgaaacccgtaaacgaacatcagactaatgcagcaaaagtgactcatcttggtgtttcctttgacttatagtacagaattaaaatatacggcctagtttttcttgattgaaataccctcttgtgattaagaaatgttattctcttattttctactggtttttttttttgaacgtgtttctattttattttaccaacaatttaaaactatctttagggccgggtgcggtggctaatgcctgtaattctagcactttgggaggccaaggcgggcgaatcacaaggtcaaaagatcaagaccatcctggccaacatgatgaaaccccgtctctcctaaaaatgcaaaaatcagctgggtgtggtggtacgcgcctgtagtcccacctactcaggaggctgaggcaggagaatcgcttgaacccaggaggcagaagttgcagtgagctgagatcacgctactgcactccagcctggcgatagaacaagactccgtctcaaaaatataataaaataaaataaaaaataaagctatctttatttaccaaagattgccaaattcatatgaacttgaaaagcatgcaggctagttatttaatttataagtgttcatttatttataggtcagtgataccatgtagacaatatacaaacatacatgtatacctgtacacataatacagacagacaaaagtaaagactttataactttattttaaaattttagccatgaggccaggtgtggtggctcatgactgtaatcccagcactttgggaggccgaggtgggcagatcatttgaagtcaggagttcgagaccagcctggccaacatggcgaaaccccgtctctactaaaaatgcaaaaaaaattacatgggtgttgtggtaaacccctgtaatcccagctactggagaggctgaggcagaagaatcacttgaacccaggaaatggaggttgtggtgagccgagattgcaacactgcactccagcctgggcaacagagtgagactccatcaaaaaaaaaaatttttttttaataaaacataaaattttagccacgagaaatggctacatttgctttctcatttaacatttgctttctcataccttcccaataaaactcactagtttaaaaggatagttgtattcaaactatgcctttgtaaatggaaaaggttaaagtttatctattccacatgaccaaagcccttactcatttttttctctactagtttctgaagtttgtagtctgatatttgagatgtcttacagaatgtctagcattctgtttgaagttttattgtgttgtttagcgtgaattgaaaagcgcgttaaatgcctaattaggtgatgtggagcatatgaagttagaccatgtggtatatgaattaaagtaaaatgtatgaaaaattacttcatatacatgccatacatgcttattacatatttaatagactttagctcacttagcccagaaaaggaatttaaatatggaaaataatctgttacaatttttcaaacttgatacaactcaaagactttcaatagctagtgggtgtgttgtttctttgtgttctcatgtttaaactattgggatgaagctatattgttgctgataatcaaatcattttcagctggccaccagagtgaaaataatattcaagcgcacaattgaattttgcaacaatataaggaaatctaggatccaaagtaaatataattactttattactcccctagctgggcacagatttaacagttttgttacggagcagcagaactgtattaaaggttgtaaaaagttgaaatgcctcagagatgaagtctactatttaattcctgttaatacacatcataggccaggtgtggtggctcacccctggaatcccagcactttgggaggccgaggcaggccgatcacgaggtcaggagatcaagatcatcctggctaacacggtgaaaccccatctctactaaaaatacaaaaaattagccgggcttggtggtgggcgcctgtagtcccagctactcaggaggctgaggcaggagaatggcatgaacctgggaggcggagcttgcagtgagctgagatcgcaccactgcactccagcctgggtgacagagcgagactccgtctcaaaaaaaaaaaaaaaaaaaaaaaacaaaaccacacacacacacacacacacacatcatagatttataccatcaaatgataactttgccctcattacttcttttttctcttcttaaatattgtcattccccaagatcacttctttgacttatagctgttttctgtaaatatttatttcctaaaattatattctgatagtttaaccaatcaccttgaaatttatgagttttaaatctacatgtttagccctcactttgcacctacattctagatccatatagctatgtgtctataaaacattttcatctggatgtcatactgtagttccaaattcagtttatctaaagcaacatttgctttctcataccttcccaatttgggatataggtagcattaattatagtttccaggctaggatttggaatcatcctttgactctttctgctccattatgacatatattcattttgtcattttcaaatgtatctgattcatcagtttctaacatttcctctgtcttcctagtgtaagtcctcatagcttcttacctaaatagatactggagatactgtagggcataaggcagatcagatttcagttctcagggagcttaaaagaaatcttgactactggttattgcctcctacataatgttcaaactcactctatcaaaaggaagccaactgaagccatgttcagttgtctccatgttcagatgttactttctagagcagtgtgcaatagcacacgtactatcacttcctaatttgtttacttatctgttttccttactaagttataggagatgaagataggatgttatttttgctttctgtttttatttttgaggcagagtctcatcctgtcacccaggctggaatgcagtggtatgatcatagcttactgcagccttaaactcctaggctgaagcctcctgagtagctgagactacaggtgtgtgccaccatgcccaactgtagatttatgatttatttttgtatcacagtgcatagtgcaatacctatcacatacatcagtgaaccatggatggatgaaagcattgtagatacttccattatactttgtcattggatttaaacagtgaccacaagtgaatataggagattctatatactttgtcattggatttaaacaatgaacacaagtgaatataggagccttttttttttttttttttttttttgagacaagagtttcactcttgttgcccaggctggagtgcaaatagagcaatctcagctcactgcaacctccacctcccgggttcaagcgattctcctgccacagcctcccaagtagctgggattacagccacccaccaccacagccagctaattttttgtatttttaataaagatggggtttctccatgttggccaggctggtctcaaactccttacctctggtgatccacccacctcggcctcccaaaattctgggattacaggcgtgagccaccatgcctggccccgtaattatctgtaatttgcttgttcaaacttactctaactttctcatataaatccagtcaaattaatctctttactatcttctaaataccccatctttgttcttacctgttctttcagtgcttctttctttccctgtcatagtctaatataattgtcttctttttgaactttcccttttctcacattgacatgtggctcttaaatgttgaataatttagcagtcccttatattgatcagtattatgcatttttgtctgtaccgttatattcattcaatgtttaatgcaaagtttgtctgatctccttaacttgattggcaactctgtgtaagttggttctgtgtttttcaacttttgttgtctgtgaaatgttggaagcccagtattaaaggttagctataaatatttctccaaacgtgataattctgtatatataatagcacagatcactgtttaacaaagggcaattgtgtcattattcattcttgttgatatttttattatctgagtatctatgtaattatagtattaaaattttgacttaatttaggctagtcagatcatcaaacacctaaaaaaaggaaattttaaattgttctgttggaatattataacaggtacaagtgggacatttctttattccatgtctgacaatattagtaaatgatatatattttttagtaccttgtcttagcctaatgttttgagtcttctgtatttcataactctgatttaaaaatgaaggccgagcgtggtgtctcacgcctgtaatcccagcactttgggaggccgaggcgggcggatcacctgaggtcaggagttcaagaccagcctggccaacatggtgaaatcccgtctgtactaaaaacacaaaaattagccgggcatggtggtaggcgcctgtaatcccagctactcaggaggctgaagcaggagaattgcttgaacccaggaggtggaggttgcagtgagctgatatcaggccactgcactccagccactcagtctcaaaaagaaaaaaaaaaaaagaaaatatagatttctgtaaatctctttttactgcctatattgacatcatttattttattattcaaaaagaaagataataaagcccatcaaaatgcttgatttataattaggagacactgttttcttacaaatagcctacctattctcttgtatgtttcttttctctaactctatttcatcaacttttctatttatttatttatttatatattgtacatatccaagcttatactagaatagttttaagatgaattcatgctctttttcttggccccagttactccagttacttcagtctcctgttgtccccacaccctcccttcttttttttttctttgagacagagtttggcttttgttgcccaggctggagtgcaatggtgcaatctcagtgagccgcaacctccgcctcccgggttccagtgattctcctgcctcagcctcccaagtagctggattacaggcatgcgccaccatgcctgcctaattttgtatttttagtagacacagggtttctccatgttggtcaggctggtcttgaactcccaacctcaggccatctgcccgccttgccgcctttttttttttttttttttttttttttagtcttgctctgtcacccaggctggagtacagtggcgcaatctcagctccctgcaagctctgcctcctgggttcacaccattctcctgcctcagcctcccgagtagctgggactacaggcgcctgccaccacaccgggctaattttttgtatttttagtagagatggggtttcaccatgttagccaggatggtcttgatctcctgaccttctgatcgcccgccttggcctcccaaagtgctgggattacgggcgtgagccaccacgcctggccacacccgcccttctttaaaagcctctgtaagtgcaatttgttctttaacgatttttcctgatggactctttacccaacaattagaaatacattggcttgatgatgtgatgaaccatctgtagaattgaccagtacccccagaattctatttgtacttaacctttctttccaagcaaaggaagctgtttattttttttcctgagtgttccattgcaatgtaaattttatttatttatttatctatgtatttatcttcagagatagagtcttgctgttgcgtaggctggggtgcagtggcacaatcttagctcactataacctcaaactcctgacctcaaatgatcctcctgcattagcctcccaagtagatgagactacagacccctggctaattttttttttttttaagagacgaggtctcactctgtcacccaggctgaagtacagtggcaatatcctaactcactgtagccttggactcctgggcttaagcaatccttctacctcagcctcctgagtatctgagactataggtgtggaccaccatacccagctaatttttgtattttttgtagagatgttacccaggctggtctcaaactcctgggcgtaagcagtcctcccaccttggcctcccaaagtactgctatgacaggcatatgccactgcacccagcctgcaatataaatttttgaaatatatttttaaaaatttagacctatcacagaaagttgttaaatttctaagtcttaaagtcttgcattattaggaagttaattttatggattaaaataaatctacttttatgctaagttaaacttaatgtctaaatatagttttagttgtattgcatttctaaatcagatcctagtgtgcctaacatttttattttcaatgtctaattgttgaatagttttctacagtaggtattatgtctatttatcttcttgatttctttttttttttttttttgagatggagtctcacttttgtcactcaggctggagtgcaatggtgtgatctcggatcactacaacctctgcctcccgggctcaagcaattctcctgcctcagcctcctgtgtagctgggattacaggcatctgccaccacgcctggctaatttctgtatttttaatagagatggggtttcaccatgtttgccgggctggtctcgaactactgacctcaggtgatctgcccacctcggcctcccaaagtgctgggattacaggtgtgagccactgcaccaggcctgtcttcttcatttctaatggttatgaatgtgtataatatactggcctgttataggtcagttttcttaagattccattgtctttttaaaaatctgtcttaggaaatgagaagagatacaccagaattacttgggattttttttttttaaaccactagggattctgatggcttaccttctttgtcatccctttttggaaatccaaaatgcacaccaccatacccagttaatttttgtattttttgtagagaaagggttttaccatgtttcccaggctggtctcaaactcttgagctcaagcaatccacctacctcagcctcccaaagttctgggattacaagtgtgggccactgcaccaggcctagattttcaaattttaaatatgtatcatatctagtaataaaataatttattctcctaaagtgttaatttagtcatacttatattagagaagtcattggttattaggaaaacattcctaaaaatggtgcccatttctttaagaaatcattcaaattttaagtggcaagcactaaaattaacacaaaagagaaattcttaataaaaattacatattttcagagtcttccctcttatatacttttgtcttggataaccttcacaaaatgtatccttttatatccagtaccccaaaagttgccagctttcacttgtttactttctggtctgccttccgtatagattccttcttttcttctctctttactcttgaattaatcctctacctacttcacaggccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaaggtgagcgtgggcctggcctccatgctataaccatgaaacccacctctaagttttttggttgaatttgtgtagaatttcccccacttattagtggcagtgtaacctaaattttttgttttttctttgtgacggaatttcgcttttgttgcccaggctggagtccaatggtgcgatcttggctcaccgcaacctccacctcccgggttcaagcgattctcctgcctcagcctcccaagtagctgggattacaggcatgcaccaccacgcctggctaattttgtatatttagtagagacggggtttctccatgttggtcaggctggtctcaaactcccgacctcaggtgatctgctcacctcaggctcccaaagtgctgggattacaggcatgagccactgcgcccagccaacctcagtattaatacaaagaggttctgtggagtttttcagttttattttgaaaacttttataatagtggaatttgtaaatctgtaaattattttaatttttaaaaattttggttatcttatgtgtattattgatacagctatgatttaaaacttagaatcttcagaaattttagaattaaattgtttaaaatgactctagactttacctaaggcaaatgcttctagaaaatacacttttccaatttctcatctaaaaacattttgttatttcaggtacaaatattgcccaggtagctttttcgttataaggaaagccacaaagggaatggttttctccacactgaagataagattatttcaccactgacatagcagaggaaggctatttttgaattttttctgagaggcttaaaatttatatttaacaatcaatatgtgaagagttttttttatatttattacacagattcaacatatttttcttattcactgtgttacttctgctgagcatttaacttagtgaaagttcagaatctacctgtgtgcatgcagccctacccatgcatgcatatcagagtgttttactctattacaagtttttaggctagttttctgcctgcttatattgtttagtagtatttgtggagctatttctcttttctataaaagttgattgtgaccttagtgtgtgatacattacatttttatgtgatacatggaaatttttcatcataacatgctttgatttcttccttagctgtttttaaagtaattaaatttttatttaggctcatgacaagcattgtttttataaaacccagaagaaaatgtagttgttctagaaaattatatggtttgtagaaaaaagggaaactagagactgacttttacctaggcactgttttcatagttcattttagtttaggaaaattatgattattggggatagaaaagagattcatatgtgctaggagttatataaggttatatttataagaatttttcaaacactttttggtaatattgatattgatataaatataaccttacaatattatgtactttttctataatctcatccttttttcataaattttatcattttttctcattgcttttgtgatttgtttggattatatttatttgcaattatttataacgttttaaggctttttcatgcatgtatatcatatcaccaattagattgtaagctcttggagggcaggaatttttatttattttgccttccattttgtttgtatccttttctacctttatacccaccccccacagtactttgcacatcacccacccgccacagtactttgcacattgtctttaactgataattgcatgcttttctcgttgagcatttattcttataactgtgactagggtaataactctttaacttctggtattacaaggttgcttggtttacactttcaatattctctaatttttgtaagggctttttcatctcattggataattttgaggtttttattatagtggtttatctcaatctttgttgtcaatcatttcttatatcttaaaggtgataattgtcagaaaattttgatttaatatttgtatggatttcaatctattgtaagtagatttattttcagtgccttctctctccctttcttgtactcttctccttcttcctcccctggttcttactgccaccttctacttcaagtccccaagaccctcatgttgccctcccattcctttcacaagaaaataaattcaccgatactaaggaatataaggaaatgacaaaagatgatgtcctcagtgaagtagagaaggggctgttacatttttggatttccctatttgcaagttaatcttacgtgagctgagtgttgccatttaacatttcttgtctcattctggcattctctagatgatagtggcaggatagggcacctacaaaggggaccaagaacaaaaagatgcaggaacatcagctccaacaaataaagagggataagtttgggtgaactgactaaaaaggaatactgaggagacctaaataattgttaacatgtttccagggatccttttttttaattgagacagagtcttgctctgtcacccaggctgaagctgaatcttcctgttgtagagttgatttttgtgtgtttttttgcttttttttttgagacggagtctcactctgtctcacccaggctagagtgcagtggtgcgatctcagctcactgcaacctctgcttcctaggttcaagcgattctcctgcctcagcctcctgagtagctgagactacagccgtgcaccaccacgtccagctaagttttgtatttttagtagagatgggggtttcaccatgttggtcaggctggcctcgaactcctgacctcaagtgatccacccgcctcagcctcccaaagtgctgggattacaggcatgagccaccacacctggccatccagggattctttaggtatattattaactgtccaaaaagtagggagaggtaattatggctgttccctaatttatcaacaagttggattccaaatgttcattactgtgccaatgtggaagtaatggttgggttcccagtatggtttgcacttgtagccaaagcaggcagaacatagagtagaaaaaaacattagtcagccaggcgcagtggctcacacctgtaatcccagaactttgggaggccaaggcaggcggatcacctgaggtcaggatttcgagaccagcctggccaacctctctactaaaaaatacaaaaattagctgggtgtggtggcaggcgcctgtagtcccagctacttgggaggctgaggcaggagaattgcttgaacccgggaggcagacgtgtggtaagccgagattgcaccattgcactccagcctaggtagcagaacgagactctgtctcaaaaaaagaaagaaaaaaagaaaaaaacattagtctagaatcaagagatagtctgtgtattgcttttcaagtcacttaaactctctgggccacaatttcttcatctgtatgaagactgctgaattagaataaatgatctttctcagttttaaaattctgtggccacattcaagttggaatcattatatataacacaagtattatgagaaaatatgtttcagatttcaggatgtctgaaacagatctattcccaaatccatgaaagaaagtagaaactttattgccactattgtgactctacagtgaaagataacaaaaaatgaagcacacacttaatgctcaatcaataggggctcttctctgctctctagtagtaggagtagtttcttaagttgtgaggtccctaggattagagattccagctgcaggataagattctggcttcacctaaatatactttggctttggtctccaaaattgtgtattatgaattgaggctttggcagcatatctgccagtagggagctgaagcattccagccttttatctgatacctgttcatttcatattaatcattggggtcagcactacttgtagagtgttttgtagaattgaggcctatttttcctgtgtttacaattatttatatatgtaagtatatatataaattatatataaacaatatataaaatatattctattttaataaaaatgtttgcatatttataatatatttatatagatatataaatggttatatatttataatatatttctattatatatttataacatatttctattatatatatttatatttatattatatatttaatatatttatattataatttatgatatatttatattatatatttatatatatatattttttggagacagggtgtccctctgtcacccaggctggagtgcagtggcatgatcatggcttactgcagcctcgacctcctggggtcaagtgatcctcccacctcagcctcctgagtatctgggactacaggcatgcaccaccacggctggctagttttttgtattttttgtagtggcaggatttagccatgtttcccatgtttcccaggctggtcttaaactcctggactcaagcaatcaggccacctcggtctcccaaagtgttcggattataggcatgagccgctgcacctggctcctcactggctttttgccccgaattcttgctttttttttaaattttttttattttctaagatggggtcttgctatattgcccaggctggtttcaaactcctgagctcaagctatccacttccctcagcctcccaaagtgttgggatcacaggcgtgagccactgcacccaggcgatagagctttctttcttttatcttttttttttttttttgtcgcccaggctggagtacaatggcgtaatctcagctcactgcaacctccccctcccaggttcaagcaattctcttgcctcagcttcctgagtagctgggattacaggcgtccaccatcacgtccagctgatttttgtatttttacaagagacagggtttcaccatgttggccaggctggtcttgaactcctgacctcatgatctgcccgcctcagcctcccaaagtgctgggattacggcgtgagcaaccacacccagccatggtagcgctttctttaatggaggtggcctttcttgacttcagagggaatttaggaattatttaataaactatggatatctttaaaatattcctttaatattcattttaccttgatgaactatttaaaattttgctgcttcctaaaaggaactaaaatattagttcttataattatatttagtggttatctgttattctacattagatttggttaggtgatttcataatcatgtactactgctttacagataaatgcaaagaggttgttggtagaaacttgaattctgggtagaatagctacactgaatatgaactccagttaatttaaaagtcctatgaaattctgaaaacaatgtgaagataccatattaaaactttgctaacaggtataaattaacaaaaaaatacttcatatttattgaggacattgcaagtaatgactgccttcatgtatattattttgaggtaggaaacacagttgttatctctattttcctgagaagataattacaggtccaaataattttaggaactagatcatgtttgttaagtacgtgagctgggagtacatttgtttttctgttcctagacatttgctcttatcctgatttcgctttttatttgttcacttaaaaattccaaaaagggccaggcgcggtggttcactcctgtaatcccagcattttgggaggccaaggagggcagatcacaccctcctggctaagatggtgaaaccccgtctctactaaaaatacaaaaaaaattcagcccggagtggcggcgggagcctgtagtcccagctactggggagcctgaggcaggagaatggtgtgaacctaggaggcggagcttgcagtgagccgagatcgcctactgcactccagcctgggcaacagagcgagactacgtctcaaaacaaacaagcaaacaaacaaatcccaaaaaggacgggcacggtggctcatgcctgtaatcccagcactttgggaggctgaggcagctggatcacgaggtcaggagatcgagaccatcttggctaacaaggtgaaaccccatctctactctctactaaaaatacaaaaaattagccgggcgtgatggcgggcacccgtagtcccagctactcgggaggctgaggcaggagaatggcgtgaacccgggaggcagagcttgcagtgagccaagatcgcgccactgcactccagcttgagcgacagagcaagactccgtctcaaaaaaaaaaagcccaaaaagtggctgggcgcggtgggtcatgcctgtaatctagcactttgggaggccgaggcgggtggatcgcctgaggtcaggagttcgagaccagtctggccaacatggggaaaacctgtttctactaaaaatacaaaaaaattagctgggcgtgatggcgggcccctgtaatctcagcaactcgggaggctgcggcaggagaattgctggaacctgggaggcggaggttgcagtgagccgagatctcgccattgcactaacaggctcggctacaacagcaagaccctctctctcaaaaaaaaaaaaaaaaaaaaaaaaaaaaaaaaaatgctgggcgctgtgcctcacgcctgtaataccagcactttgggaggccgagccaggtgtatcacgaggtcaggagttcgagaccagcctaaccaacatggtaaaaccccgtctctactaaaaaaaaaaaaaatacaaaaattatccgggcatggtggcgcacgcctgtaatcccagctactcaagaggctgaggcaggagaatcgcttgaacccgggaggcggaggttgcaatgagccgaattcgtgccactgcactccagcctgggcaacagagcaagacttcgtctaaaaaaaaaaaaaaaaaatcccaaaaagtaaagacaccttttcctttcaataactttcctattaaatttctagaaaattatccactgctacatgatgattaagtcttatcttaatttaatcattatattaaagtcctaaaagatgtgtttatagccataaggtgaggttctataatgtggatcctaaggagagctttctggagaggtacccgtgattattttcccttttaaaaacaaagataggctgggcgcggtgtctcatgcctgtaatcccagcactttgggaggccgaggcgggcggattacgaggtcagaagttcgagaccatcctggctaacacggtgaaaccccgtctctactaaaaaaatacaaaaaaattagctgggcgtggtggcgggcgcctgtactcgggaggctgaggcaggagaatggcgcgaacctgggaggcggagcttgcagtgagctgagatcgcgccactgcgctccagcctgggcgacccagtgagactccgtctcaaaaatatatacataattttttttaagtaaagagttcattgataattgattagcatgtatataaagtaaaagtgtgaaatggatataatttcaggctttaacacatattaagacagatttgggattatcatacctagtggattatactatttaaagatagatcatttgttaagaatatggggtaggctgggtgcagtggtcacagctgtaattccagcacttcgggaggctaaggtgggcagatcgcttgaacccaggagttaaaggccagcctgggcaacatggtgaaaccctgtctctacaaaaaaaaaaaaaaggaaaaattagctgggcatgtggtgtgtgcctgtagtcctagctactcagaaagttgaagtgggaggatcccttgagccctgggaagttgaggctgcagtgagccgagattgtgccactgtactccaacctgagtgatgggactgagaccctgtatcaaaaaaaaaaaaaaaaaaaaggtgcaaaatggttacctgaaattctagaaatgaaaatttctgtaagtttaacaggaaagttgttgaaaaagaaagttggtttgtttgacttttttttttttttttttttttttttgagatagggtttaactctgttacccaggctggagtgcagtggtgtgatctctgcttactgcaacctccacctcccaggctcaagcaatcctcctacctcagcctcctgagtagctgggactacaggtacacacaaccatgcctggctaaattttgtatttttagtagagactgggtttcagcatgttgcccaggctggtctcaaactcctgagctcaagtgatctgcctgcctctgcctcccaaagtgctgggattgcaagcttggacaaccatgcctggcctgttttgcatttttgaaagaagaaagttttagagtgttaaaacctctcatacctaaagtaatagtttttagaaaactatagtatacatatgaatttagattccaatgtatgactttctttaaattatattaacaaaaattaagctattgggtaatagtatgtgacccagaatgtaagaaaagtgattttttaagtctgcagagaagccaaaagatatcataaaaatccatgtactctacgccaggcgcggtggcttatgcctgtaatcccagtactttgggtggctgaggcaggtagatcacaaggccaggagtttgagaccggcctggccaacatggtgaaactaaaaatacaaaaattagctgggtgcggtggcaagcgcctttagtcccagccactcaggaggctgaggcaggagattcccttgaacccaggagacagaggttgcattgagctgagatcatgcaactgcactccagcctgggcgacagaatgagactgcatctcaaaaaaaaaaaaaaaaaaaatccatgtactccaaagggactctccaaggctctcatcaaaatacttttcattcttgttctaatataattttaatactcttggctgaggccggtggatcacttgagcccaggagttccagactagcctgggcaaatggcaaaaccctgtctttacaaaaaatacaaaatgtagcctggtgtggtggcgtgcacctgtggtcccagctacctgggaggttgaggtgggaggattacttgaggccgggaggttgagactgcaagtgagccatgataataccactacacttgagcctggccaacagagcaagattctgtctcagaaaaacaaacaaacaaacaaacaaaaaaacctcttcagcagtctcatttcaaaacctgtaatttgcagcaaaattagaaaagaaggattgctattggcaggtaaattgacaagaaggcaaagtgatcacaactcatagccaagaaagagccagaaaaatctgtaatagccaaataaatcaaactccatagcactatttggagtaatttaatacagccactcaaagaggctttgaggattttagtaacagtaatcttttttttctgtttagttaagaaaaggttaaactttggttgttataccccatttaggaagccaagaggaagctacttttgcagagacgtaaagaaattcactaaaatgttaaatgttgggattatgagtgacttttatttttctgtcttttataattttaaaaatactaatattggatacttttataatttagaaaaaaaaattgatgtttaaaagcctgaaaatgtgtacagaaatgtttctaccaaagctttaatttaaaggactaaatatcatctatatagaaataatatatttaggctgggcactgtggctcacgcctgtaatcccagcactttaggaggccgaggtgggcagatcacctgaggtgaagagtttgagaccagcctggccaacatggtaaaaccccgtctctactaaaaatacagaaattagccaggcatggtgacaggtgcctgtagtgccagctacttgggaggctgaggtaggagaatcgcttgatcctgggagacagaggttgcagtgagccaagatcgcaccactgcactccagcctaggcaacggagtgagagtcggtctcaaaaaaaaaaaaaagactacatttatataaaaatattaactcctcaatatttgtgcgttcctaaagttttactagttatgtctatctggctctatttctgtttgtctgtcatctatgtctattttctaaagatttgttaaaattaatcttgcaaaatagttccacatacttttcactctttagccaagcaactaagaaatagaacactatttgtactaggtgtaaaataacaagcaggaaactaccttaaggctatgaaaaactgagacattaattggatttctgcagtgatttaaaaaataatatgttgatacaaaattattttacttacagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgtttc

SEQ ID NO: 1172 - DNA, 127052 bp, Homo sapiens; identical to SEQ ID NO: 1171

SEQ ID NO: 1173 - DNA, 134023 bp, Homo sapiens
agggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgaggtaaggggccgcggcgggcgggcgggcctccggcgcgcggccgggcgcctccatccccgtcgcctccatcccgcgccctgggcggcggggcccgggggcctcggggctgcccggcgcgggcccggcgcggcgcaggcccggcccgtcccagcggcgacggcggggcgcggcttcagcctggccccgcgccccagccgggctgcctcccgcctccggacgcctcaacttcggcaaactttgtcccggaggccgggctcggggcccgagggggccggggcgcccgcaccttttcaggaaacggggcgcgcaggcctcgctacggccgtgacccccgctggcgttgaggacccggcaccccgcggggccgcgggtttcacgcggggggacgggcggctcaggggctgcgtggccgagcgcgctgcccgggccggccgggggggcccgggcgttattggaaagttggtcctgagtcattccgcctcagaggcgcctccgaccgcttggcgggcggcgcgggggtccgggtatgggcagagggcgcgaatccccctcgcgcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagctgttgacgggaccagttgtatttcacgtttttcgaattaagctcagaatcagttttcagaatgacatgtgatgcgtggtgcgtggtgtgtgtgcctgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaagcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataataccttttttttttttctttcggtgaagcttattgtcggcctgtacagatgacttggagtaggctggcaggtagtgggatgtcataaatgttgatgcctgttggtttctatcaactttaggaatcaggttggaatcgatgctgcattctgtattcctcgagataagtggattgttaattgggacttgggagtctttttctcatttaattaatattcagttaatgtgccctgagttctcataatgttctggttaccgtgctgggaagagtgagacacagcacccatctgctagggtgtgatttgcagggatataggccatcttggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacagggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaacagccccttcctagcctggcatgcgcacctgtggtcccagttactccagaggatgaagtgggaggatcattctagtctgggtaacacagtgagatccctggctctaaaataaatttatttatttattttattttatttgaaacaggggctcactctgttgcccacgctggagtgcagtggcccgatctcggcttgctgcaacctccgcctcctgggttcaaatgagtctcctacctcagcctcccgagtagctgggattacaggcgcctgccaccacgcttggctattttttttttttttttttgagacagagtctcactctgtcacccagactgaagtgcagtggcgcgatctcagctcactgcaacctccacctcctggattcaggtgattctcctgcctcagcctcctgagtagctggggaccacaggtgtgtgccaacatacctggctaatttttgtatttttagtagagatggggtttcaccatcttggccaggctggtctcaaactccagacgtcaagtgatccacctgcctcggcctcccaaagtgctgggattacaggtgtgagccactgtgcccagccttcccagctgatttttgtattttttagtagagacagggtttcgccatgttggccagactggtcttgaactcctgacctcaggtgatccacctcagcctcccaaagtgctgggactacaggtgtgtagtcccaccacactcggcctatttgttttttttgagatggagtcttgctctgttgcccaggctggagtgcagtggtgcaatcttggctcactgcagcctctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattctcaagaactgaaaaattgggggccctacatttcatttcacaatttacttttttactacgatttgttccatgctgatttcgagcattaaaaaaaaaaaaaaattaaatggaggctatttggtggtaacttctcatgaggccattctaccaagaaagatatggcgacctgctgcttggacattctgatttcctttccagctgaaacactgattctgtggcagaacccaaaagcgtatttattggaaacttgatttctttaagtggaaagaaaagctaaattgattaaccaagtggggtaatataatctgtaaggcaacagtagcatcaaagtggtgaaatgtgaatctccaggagtcatgagaattgtaatgaaggtttcctgagattaattttgtgttctggaaggttaatgcccgttaggaggcctgcgtacacaaggtaatgaggtgctcgttaggccttccctccttccaccaagggccaggcacatggtaagctctgggtcagtgtttgtgtccagattctgcaagccggggagacaggagggatgtgccagatgcccacagtggttccatgtgtttggaatgtgtgtcggcacttgggtgtgccttgtagctgcctcctttaacggtgtgttcctggaggtcaggcttccatcctcccgttctgataatgcttagctccaggatttgttgcattatgggggttctttgatggaaagttttatttgacaatgtaattttcttggatgcttttaatgacttaaaagctggaagaacaggaaaactagttctcttgagctctttcatgtccagtaattcccagaaattataactttatgctggaaattaaacctgctatttgaaaccttattacagggtgaattaagagtttaggtttcagaggcttttctgtgtgactttccccttagtgggagggggtttggtatgcccattaagttttatcttaaaatttaatgtgaattttacattgtactcagtaacgtggctgattgttttaatataaacttacttcgttccctaaatctttcaaaactgttgattctccaaaagatgtattgtgtttctggaatcccactgtgtatccctggagctgtccaccccacagctggagaagtgtggcatggtggagggtaccaactttgaggatctgaattccagtctgccctctgtatttagtggtagaatgaccttgggcaggctgcttggccccgctgaattgatgtccctatctataaaatggggctactagcaccagggacatcacttgcttattatgagtaagatggatgggaaagcattgtgcaaatgttaattttcatagtattaggggattgagatgtaacagagtaagaatgttaagatcttacaatgtaaatatcagatcttgttagttagggaccacagaagttttctagttgaggtctcttattttatgtgggaggcagctgaggctctcagtgtttaggtaagtaattctcccaaggcaaataatgacaaagcaagggctcttcacgcaggataggtttttccctgcatttttcctgttcccaacgtttgctcctgggaagatgcttggcctttttttttttttttttttttttttttgaggtggagttttgctcttgcccaggctggagtgcagtggcacgatctcgactcactgcaacctccgccccctgggttcaagctattctcctgccccagcctcctgagtagctgggattacaggcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttcaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattctaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcctcggattcactctcctttgacacatttggatgggaggttctttacgcagtggctcagatgcttcttacagcttgctgagtaacagtccctaacctgatttgctaatgtgttttctttctcctttctctcttaatttacatttaaactggtagtctagtaataatgatagtatttagtcattgtgtcttacagggttttacaaacattagcttgttagtgatgaacaagtccccaaggcctggtcactctgcagagagcataatggttgcaggctagtacctattcatcttgaatttaattataactgcagattgcctgtggaaatatgagttaaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtggaggtggtggcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaaaagcctctgaaacctaaattctccctctggagatggatggtggtgatggtcgcacaacattatgaatgtatttaataccactggactatacacttaaaatgattacaatgataaattttatgtgtaatttaccataataaaaaagtaattgtgagacttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaaaaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctgggtctggtggcgtgctcctgtagtcccatctaactactcaggaggctgatgcgggaggagtgcttgagcccaggaggtcgaggctacagtgaggtgttactgtgtcaccatacttccgcactttagcctgggtgactcagtgagatcctgtctcaaaacaagaacaagaaaaatcagagcatgtgagagaatataagaacctaatatttcagaagtgatcatttctcttcccctttcctttcctgagtggtttgataaagggaatgacttattagcaatgtggatgacaggctgtcttggaagtatggcctgtccctggaagaaataccggtgggagtagaaggacattattggactgcaaataaattatttataaaaagggtaaaatgtctagaaactgaaatcacagtatatttgcacaaaaggaacatctatagatatctccctttttaaaaagcaattttaacatatgaatttttatatatttaaattcgtattttagcacttttttttctgttatttagcaataataatattcttcaatttgggctgggcgtggtggctcacgcctgtaatcccaacactttgggtggctgaggtgggcgaatcacttgaggtcaggagttcgagaccagcctggccaacatggtaaaaccccatctctactaaaccaaaaaaaaaaaaaaaaaattagctgggtgtggtggcacatgcctgtagtcccagcaacctgggaggctgaggcaggagaatcgcttgaattcgggaggtggaggttgcagtgagccgagatggcgctactgcactgcagcctgggtgacagtgagactgtctcaaacaacaacaaaaacaacaacaacacttcgatttattcaggcctctgttcacattttacctcttcaaaggggtcttctgaacaccctaattaaacagcccatgctgttgctgtggtcacttgccttgctttttttttttttccatagcagaaaatggttttcctttcctttttcttttttttttttttgagatggagtctcccagtcacccaggctggagtgcagtggtgtgatcttggctcactgcaacctatgcgtcccaggttcaagccattctcatgcctcagcctcccgagtagctgggattacaggtatgcaccaccccacctggctaatttttgtatttttttagtagagacagggtttcaccattgttgaccaggctggtctcgaactcctgtgctcaagggatctgcccgcctcagcctcccaaagtgctgggattacaggtgtgagcccccacacccggcctgcagagaatgtatttctattaccttaacctgtgtactaggagtgtgcctggcatatggtaggttctcaagtatttgcataaatgaaccagtatattatagcccaatgttttattgaggcaaaattcacataacatacaattaagcattttaagtgtgcagctcagccgtatttagtgtattcacaatgttctgcaaccaccagctctctctagtttaaaaatcaggccaggcatggtagcccgcacctgtaatttcagcattttgggaggctggggtgggaggatcacttgagtccagtagtttgagaccagcctgggcaacagaggaagactccatctcaacaaaaataaagaattagcttggttgggtgtggtgtctcacgcctgtaatcccagcactttgggaggctgaggcgggcggatcatgaggtcaagagatcaagaccatcctggccaacatggtgaaaccccgtctctactaaaaatagaaaaattagctgggcgtggtggcgcatgcctctagtcccagctactcaggaggctgaggcaggagaatcacttgagcccaggaggcaaaagttgcagtgagctgagatcacgccactgcactccagtctgggagacagagcaagactccatctcaaaacaaaacaaaacaaaacaaaactgggcacagtggcttgagcctgtatgtagtcccacctactccagaggctgaggcaggaggatcgcttgagcccaggaattcgaggctgcagtgacctatgatcacaccactgcactccagcctgaaggacagatggagaacctatctcttaaaaaagaaaaacaacttttcatccccctttacccattaagtaatcactcccattccccaatcctcccatcccttgataacctctaatctgcttttggtctctgtggatttgcctattttagatatagcatctaggaatcatataacttgttttttgtatctggctgctttcacttagcatgatgtttttgaggtacatccaaattgtagcatgtgccagtatttgttcctttttattgctgaatcataatccattgtatgtacatacatgccacaatctgtctattcatttgttcatgggcatttggattattttcactgactattaagaataatgctgctataaacatttgtgtacaagtttctgtgtaggtatgtttttatttcacttgggtatatacctaggagtggaattgctggtcatacggtaatatcgtgtttaacttattcccaccagcagtgttccaatttcaggacatctttgctaaatttattttttttgttttgtttctttttcatgtcatatgggtaatgtgccgacgtcataacaaggtttcagagtggcacctctcacaccttcatttgaatacccaatcacacttatgaactacaaaaggatatatgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgcccaggctggagtgcagtggtgcagtggcatgatcttggctcactgcaatctccgcctcctgggttccagcaattctcatgcctcagtctcctgagtaactgggactacaggcacacgccaccatgcctggctaatttttgtatttttagtagagatggggttttgccatgttgcacaggctggtctagaacccctggcctcaagtgatccacccacctcagcctcccaaagtgttgggattataggtgtgagccactgcactcagcctcttctgagttttattgttttagtttttacctttaggtttttgatccatttcagttaattcttgtatatggaatgagataggagtcccaattcattctttgtatgttcttatttagttttcccagcaccatttattgaaaacactattctttccctattgaatcgtcttggcacccttgttaaaaataaattggccatagatgtttgcatttatttctggactctcagttctattctgttgctctgtaagtctgttacatcagtaccacactatattagtctgttctcatgctgctaataaagacatacctgagacagggtaatttataaagaaaaagaggtttaatggactcattgtttcacatggctggggaggcctcacaatcatggtgaaaggcaaagaaggaggaaaggtatgtctcacatggcagcaggcaagagagtctgtgcaggggaactgtgctttataaaaccatcagatcttgtgagacttactatcatgagaacagcacccccacgattcagttacctccccctgggttccttcccataacatgtggggattatatgagctacaattcaatatgagatttggatggggacacagccaaaccatatcacacactgttttgattactgaagctttgtagtaagttttgaagtagtaagtttgggaagtatgagtctcccaactttttcattttctatattgttttgactatttggggccagttgcaactttatatgaatttgaatatcacctttttcatttctgcaaaaaaggtcattggaattttaatagggaggggattgattctgtagattgctttggggggttgcaatcttaacagtattgtcctccaatccatgaacgtgagatgtcttttcttttcttttttttttttttttcgagagggagtctcgctctgttccccaggctggagtgtagtggcacagtctcggctcactgcaacctccgcctcccgggttcatgccattctcctgcctcagcctcccgagtagctgggactacaggcacctgccaccatgcctggctaattttttgtattttttgtagagacggggtttaactgtgttagccaggatggtttcaatctcctgatctcgtgatccacccacctcggcctcccaaagtgctgggattacaggtatgagccaccgcgcccagctgaacttgggatgtcttttcattcaattatgtctcctttaatttctttaagcaatattttgtagtgttagtgtacaaatcattcatctctttggataaatttatttctgggtgctttatttttgtgggttctattgtaaatgaaattattttcttacctttctttttgtattgctcattgctggtatatagaaacaactgatttttgtatgttggtcttatgccctacaaccttgttgaatttattacctctagtagttattttgtgggttctgtgggatttctttatacagaatcatgtcacctgcatatataatttacctcttctttctaatttgaatgccttttatttctttttcttgcctaattgctctggctaagacatttagtaaaattttgaataggagtgatgaaagtgagcatcctcatattgttcctgatcttaggggaagcttttcaccattgattatgaagttagctgtgttttctttctttcctttttttttttgtttttgacacagggtcttgctctgtcacccatgctggagtgcagtagtgcaatcatggctgacttcaacctctgcctcccaggctcaagcgatcctctcacctcagcctcctgagtaggtgggaccaaaggcacatgccacaatgccctgctgtttttttttattttttatttttggtagagatgggtttcgccatgttgcccaggctagtcccaaactcctgagcagtcagcccaccttggcctcccaaagtgctgggattacaggtgcgagccactgtgcctggactttttttttttttttttttttttttttatcagaccaggtctcactcttttgcccaggctggagtacagtgatgtgatcatagctcactgcagtcttgaactcccaggctcaagcagtgctccttctttagcctccccggtagctgggactactataggtgcaagctgccacaccctgctaattttttaatttttgtggagacagggtcttgctgtgttgcccaggttggtctcaaattcctcaccttgagcagttctcctgccttagcctcccaggtagctgggattacaggtgtgcaccaatatgcccagttaattgattttttttttttttttttttttagtgatggggtcttgctgtgttgcctaggctgatctcaaactcctggcctcaagcagacctcctgcctcagactcccaaaatgctgggattacaggtgtgaaccactgtgcctggccactgactttttttttttaatggaaggttgttgagttttgtcaaatgctttttgtgcatcttctgagatgatcatatttttttcattgttctagtaatgtagtgtattgtattgattttgttttgtatgttgaatcacccttgcattcctgggataaatctcactttgtcatggtatataatccttttaatgtgttgttagattgagtttgctactattttgttgaagatttttgtgtctatgttcattaggaatattagtctgtagttttcttttttttttcatttttgagacaaagtcttcctttgtcacccaggctggagtgcagtggtgcgatctcgggtcactgcaacctcagcctccccagtagctgggattacaggcatgcaccatcatgcctggctaatttttgtatttttagtagcgacagggttttgccatgttggccaggctggtctcgaacacgtggtctcatgtgatccacctgccttggcctcccaaaatgctgggatttacaggcatgagccactgcaccctgcctgtagttttctttccttgtgatatttttgacttcggtatctgggaaccaatctttttttgagacagggtcttactctgttgcccaggttggagtgtagtggtacgatcttggctcactgcagccttggcctcctgtgctcaagtggtcctcccacccagctgcctgagtagctggtactacaggcacttgccaccacacccagcaagttttgttcattttttttgtacagatgaggtctcactgtgttgcccaggctggtcttcgactccaggcctcaagtgatcctcttgcctcagcctcccaaagtgctgggattacaggtgtgagccactgctcccagcccccagttgtattttgactgtgcatcatgtttcttcagaattttgaaacctgccctctcctaattgagaaaattctaagagggtttccaagcagacaaccctaacatctctggctgggatgatgatgattgtaccatgtacttcccctcttctcaacacagacacattcatgttgtagtgccagctgtaagcataggagttgcacttaatggcttacagctggggaaaatcatggctgatagcacaccaccagtgcaggatcagggaagggaactctattcctgatgccaggacaggaaagagatgtgcttccttcatttcatgaaaaagccacagattgttccggataatggttgctgaataagaaaccaccctaaacatcagtgatttaaaacagtaatctactactacatctcatggttctgtgggctgatcaagcagggctcagctgggtgattcttctgctccatgtggccttgatggaggtaatttattggtattcatctgttggctggtccagtcatgagggtccaagagggccgtacacacatgcttggatggttggaaggccaggctcaggggatcctccctctccttgtgctctcaggtcctctgcagatggcctttctcctaaggtggttgtgcttcttacatgacaactcagaactcttagagtgagtgttctaggagaggaagtggaagctgccagtctctctctctctttcttcttttttttcttttgagatagagtctcactcttttgcccaggctgagtacagtggtaccatcatagctcactgcagcctcaaacgcctgggcagaagtgatcctcccagcccagcctcccaagcagctgggactacaggtgcatgccaccttgcatggctaatttcttagtttttaactttttgtagagacaaggtcttaactacgttgcccaggctggtcttgaactcctgggttcaaacgatcctcccaccttggcctcccaaagtgttgggattacaggcgtgagctactgtgcccagtctggagctgccagtatcttaagcctgggcttggatatcagtgtagcattattcctgccatgttctaaaaagacacagagtcctcctatatttgaggagaggggacatggaccctaactcttgatgaaaggagggtcgaagaatttgtgactgtccttgatctggtatacgcatggtggctagattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccttcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagagaagtgagggagtggttttaaataatgaaacaggaaatctctgtctttggctccagtggtgccccagtgttttgggattaatgagggaagagctatgtctgcctgtgttccatgagtgccccttgcttgtacctctatggagaaccccaacaaccctggctggaaagccacctaatcctgtgtttcccaagcataacctccctttgttcccaagtaagtctttcctagacacctgaacttctgtgcaacataggcatgaatgaggagagtgagctactgtggtgttatatatatacacacacatatatacatgatatgtatgcatgatatgtatatatgtgtgtgtgtgtgtgtgtgtgcatagttttcatccattgtttctgactcataagtcccatagcccttgttacagtcttttgttgtaatgttgggtgtcttgcctcctttcagctgcccaaggcaggactctaatctgactgtgagtcagaagacccttattccagagagggccctgcctcattccctagaggcaggaatgctgcacagagaggccaagataagtccgaacagacaggccttgctgggtttagatcatggttttttgtccagaaacatttctagatgattgtaagtcatgcctgtgtaatgaagccaccataaaaactcaaggacaggccgggcatggttgctcacgcctgtaatcccagcactttgggaggctgaggcgggcggatcacctgaggtcaggagtttgagaccagcctggtcaacatggtgaaaccccatctctactaaaaatacaaaaattagccgggtgtggtgtcgggtgcctgtaatcccagctacttgggaggctgaggcaggagaattgcttgaacccgggaggtggaggttgcagtgagccgagttgcaccattgcattcccacctgggtgacacagcaagactgtctcaaaaacaaacaaacaaacactcaaggacagcgttcaagagcttccaaatggcggaacacgtggaggtttctgaggatggcccgagggagggcatggaggctcccgcctggcctcatacctcgccctttgcgtcccttcatctgtgtcttctgcagtatcctctacgatataccggtaactgtaagtacatatttccctgagtcctgtgagccactctggcaaattaatcgaatccaaagagggcttgtgggaaccccaacttgaagctggtgggtcagaagttctagaggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccggaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgcccttggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggtgggaagcgtagagattatctgttggtaagccagaggcaggaggaagaggaggaggaggaggagatagtggcgtccctcctgcagaaaccccgcagtggaaggacaagattgcaggaggagttagagaccagtggtctagtccccatctgtctttgtgaccttaggcaaatcattgaatctctttgaaagccttgtctccttgcatggcatatggagattatagttgctgtgaaaataaaataatcagtttttaaaaatccataaaaatgaaaaatggtatttaaggttgaaggcacttgtatttctttttctttcttttttttttttttgagatgtagttttgctcttgtcacccaggctggaggtgcagtggcgtgatcttggctcaccgcaacctccgccacccaggttcaagcgattctcccgcctcagcttcccgagtagctgggattacaggtttgcaccaccacgcctggctaagtttgtatttttagtagagacagggtttcaccatgttggtcaggctggtctccaactcctgacctcaggtgatctacctgcctcggcctctcagagtgctgggattacaggtgtgagccaccacgcccagcctaggcactcgtatttcttagtcgggaaagagaggacaggatatgtccaccacacattcaccagttcagcatgtattaactactgtgtgcctgactaagcttaggtactcagtgtattttcatgtaaagaaaaacaacatttaaaacatttaagtgagcactgaccaaatctagcttagttcagaaaaccctttttttttttttgagactgggtcttgctctgttgcccaggttggagtgcagtggtgcgatcacagctcactgtagcctcgacctctcagtctcaagtgatcctcactttctaagtttccaacattttttgggccaggtacggtagctcacacctgcaatcccagcactttgggaggcaaaggtgagcagattgcttgagttcaggagtttgagaccagcctgggctttatggagacctcatctctataaaacaaatataaaaactagccaggtgtggtggcgtgtgccattagttccagctcctcaggaggctgaggtaggaggacagcttgaatctgggaggcagaggttgtggtgagctgagatcgcaccactgcactccagtctgggcgacagagcgagaccctgtctcaaaaacaaaattttttttgtagagatggggcctctatgttgcccaggctggtctcaaattcctaggttcaggtgatcctcctgattcggcctcccaaatggccgggattataggcatgaccactgtacccggcctcagcagacctttgtaaagcacttcatgggtgccagtcctgctgttacagtgctaggtaaatgcataaaaatgctccatgaggcattctgtgttctcaggaaattcagactgccagtttcagtctggaacgtgacactttatgaaggaggcaatagaacaaaaaaaggacaaattacaggattagtaattatcaaaagctaataccgaggtcagaataggactcttgttcagtttacatgaggaatttaaccaaatgagcttctgcagagaaccagcattagggtggtgaccaggctggggtacatacatgtcatatcagaagtgacctgagactgggtgtgagaagcagtggctgatttggactactgaaagcagaattaagagtctggtggcattggggggagattagtgctgtggaagtcctgctcagagtctttctcatgatgggtacatttgggaggagcttagcagacatcagaggacctgcagagagttgacacagcgggaggaaccagctgcactaccactcatgttcttttccatcttagcatctcgtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcaatggtgcgatctctgctcgctgcaacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgctcttggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggcttgcgggctgccttctcagagccctactttattagtgatttatttctcttaatgggctattagaaatgaccacaaaaactgaggcccccacccatacaatttctatcagttaagaccctggaaattcagatttagagggaatttttaaagaactcctgggagtgctgatgccctgctggactgggagcctctggtccagtggaagcagcacattccctccaggagccccagtgctttaggaatgcagtttcccaggccctgcctcagacctgccgactcacagtcagctctcagagaggctgttaggtgatcattgcgttcatttaagtgtgagaagcaccgtgcaggctttgggtgagagagtcggggttcataccttgcctctcttctttcccagctgcatgaacttgaccaagttatttggcctttctgaaccaggaccgtagcacataaagtgagtgcgatggtgcaggccccagttcctcagccacagtgctgaaaccccagagcctctgaaaatggaatgttttttcatagatttggtgccacttggcctgaacttatgtgaggctatttataatctctattccacttaatatgaatatttcattattttaccacagatggttaattaacatgtttcctgttcttttccttttttttttttttttttttgagaagactcttgctctgttgcccaggctagaatcagtggtgtgatcaaagctctctgcagccttgaacttctgatctcaagagatcttcccacctcagcctctcaagtagcgaggactacaggcttgtgccgccacacccagctgattttttaatttaaattttgtaaagaaagggttctggccgggcgcggtggctcacacctgtaatcccagcactttgggaggccaaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtaaacccggaaggcggagcttgcagtgagcggagatcgcgccacggcactcccgcctgggcgacagaacgagactccgtgtcttctcactttgttacctaggctagtctcagactcctagactcaagtgatcctcccacctcggcctcccaaagtgctgggattacagtcaagagccaccacacccggtgaattaatgtgttttcttatggttactgcctcagacttccctggagtgttatataatatataatatataaaatatgcgtacaatatttcctttctaaaattcaaaaaattctgaactctgaaacacatctggcctcggttttggataaggattgtggtgctatagatacccagcttataggtgggtcagtatatgccatgttagtgtgttggtatgtgtagaaaactcttggcagttagcaggcacccaacaaatgcagctatttttgtttgtttgttttgagacagtgtctcactctgtcacccaggctgaggtgcagtagtacaatcacagctcactgcagcctcgatttcctgggttcaagtgatccgcccatgtcagcttcccaagtagctgggaccacgagtatgagccaccacacctgcttaatttaaaaaaaatttttaattaaaaaaattttttttggtctgctgcagtggctcacatctgtaatcccagcgctttgggaggccgaggcgggcagatcacaaggtcaggagatggagaccatcctggctaacacagtgaaaccccgtctactaaaaatacaaaaaattagccgggcgtggtggcgggcgcctgtagtcccagctactcaggaggctgaggcaggagaatggcgtgaacccgggaggcggagcttgcagtgagccgagatcatgccactgcactccagcctgggcgacagagcgagactccatctcaaaaaaaaaaaaaaattttttttttttgagacggagtctcactatgttgcccattctggtcttgaactcctagtggtcgtcccaccttggcctcccaaagtgctgggattgcaggcatgagccattgcacctggactcattttttttttttttttttgagatggagtctctctctgtcgcccaggctggagtgcagtggcgcaatcttggctcactgcaacctccgcctcccgggttcacgccattctcctgcctcagcctcccgagtagttgggactgcaggcgcccgccaccatgcctggctaattttttgtatttttagtagagatggggtttcactatgttagccaggatggtctcaatctcctgacctcgtgatctgcccgcctcggcctcccaaagtgctgggattacaggcgtgagccaccacgcccagccaactgtttaaagacatttcaagccaagagcagaagttgtgttagaaggtggctgtattagtccaatttcacgctgctatgaaaaaatacctgaggctgggcgcggtggctcacgcctgtaatcccagcactttgggaggtcgaggtgggaggatcatgaggtcaggagttcaagaccagcctggccaagatggtgaaactccatctctactaaaaatacaaaaaaattagccgggtgtgtggcgggcgcctgtaatcccagctactcaggaggctgaggcaggagaattgcttgaacttgggaggcggaagtttcagtgagccgagatcgtgccactgcactctagcctgggcaaccgagcaagactctgtctcaaaaaaaagaaatactcgagactgagtaatttattaatataaagaaaagaggtttaattgactcacagttcagcatggctggggaggcctcaggaaacttacaatcatggtggaaggggaagcaaacacatccttcacatggtggcagcaaggagaagtgcagagcaaagggggaaaagccccttgtaaaaccatcagatctcgtgagaactcactgtcacaagaacaggatggtggaaactgcccccatgattcaattacctccccccaggtccctcccatgacacatggagattatgggaactacaattcaaaatgagatttgggtagagacacagccctatcagtggcttacgctcctggcttggcctcctggcaggctttttatagagggagtgggatccttgctggttatgaaggacttgtgttccttagagttacagtcttggaatgtcagccctcagcttcttgtttttcttttcacccagatggtgcacataaggaggcagcgtgaggtggggtggtggctaagggcgtgagtgctggtggcaggctgcctggtctgagtgaccctgggtcttgggcagttaccttccgtgtgtctcagttcttttacctagaaataaggataatggtacttaccccctggagtgtgagatggaaagcatttagcataggtaagctcagtaaaatttagcagttttagttatctaggactataatggaggttaagttggccagaagtataattttttttttttttttaagagacagggtctcgctctgttgctttggctggactcaagctcctgggctcaactgatcctcctgcttcagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgtttaaaaaaaaaaacaaaaaaaacttcagaggagtcatatgattgacttgtgtgtgtctacgcagactcccttttctctgtagagacttacaatcttcagttctctggagcgttcttcagattcccttgctccatgactgaccttggctaggaaaataattgggccgtttttggtgcacagcagatgaaaattatcagtatgtccctagctttccactgtgaggccgccgtagcaacagaggacagtggatgtgtgacttgtaccctttcagagggccaagaacgcaatatcctaaagcagccttttctttttttattttttgagtcagggtctcactctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagcgacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttttctaaaattcatatgaattttgagttctgctgtatgatatgtaatatatatgttctaatattacaaacttctaaaaatctttctgtgcaccaaaattgatcctccaggacagaaaaaatgccagtggttcttgtctataccaccatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtaccctttggtttagataatttagataattagcaactagttttggtctcattatcagacattttactctggacaccccatcaccactcccatcatgggggagtttggaggccaggagattcactggatgcttcttttctagtgtgtgctcttcttagatgggaaggaaaaaggtaaaacctcaaaaactctgtggtaaactgatgtgggaatctgatactaaaaatgtcccaagtgatttaaagtgtgtaagaattactcacttttctgtggagagcgatgtgcataaagacagtgacaagtggaagaagatatccagatgagaccctcactgccctcggtgagtggattgcaggatgctgggagcccccttgcgtagagactcaccgctggactccaagccctctgtggcttctgctgtggctgagtcatcgctgcccaagactactgttgggttctcctccctgctggtgagcagtgaggcaccagggagcccctgcctgcagccagctcggtgattccatgcagttttacatagggaaagaatgctctacctggctacgttttcctgtgtcctgttgaaatgaagaggttagtcatgcattccctcagctagagcgtgaggcagtccttccgaagattgtccaatttagacccagactcttcaaaggaaatgtcagcatgttttgatgtcatggttcaaaacctcactgggatggtttgtgtgagtacatacctgttttacttttagtttcactagaggatgtcatttggactagttgtttttaagtgaacatttcaaacttaactaaatttgattcctgtttccttggttgtagttacatggaaagaccactgggtctgggacagtggttctcatccagagatggagttggtggggtgggggtggggtgcagtttcgtaccctagggggcattttgcagtgtctggaaaccttcagaagtggggtgggggatgccactggcattggtaagtagaacgagggatgctgtgaacaccctgcagtgctcagcatatccctacagcaaagagttttcgggttcaaaatgttagttgcgccaaggttgagaaaccgtggcttggaaattgttcattcaccatactcttcttgatttctagtgaatgtatgactgttaagattttatgttttcataaggtgaggtactttctacagaaattcagtctctttagtcattaaacagcagagggcacttggaggctagagtgcccagaagtccatcaagccagtctggataaacccttcccaacatgccataatttacatcaaaactttggttagcagaatgggaatttttgagtagataccattagaaaaataaaataattttccagctgtggttcccaagttccccaaacttatgtctttagtccaagctgccccttgagcttcagcttcggacctgcatatttatttaacagctattgagtccttggtatgtgccgggcaccctcctgtgtaccagggcatggcaggaaatgatatgggcagctccctgtagtcatgaggcctgtgttctaaggcagaccttgaagacagggaagtccatgtgctgattccagaagaatagagggggcctggcagggctggggggaggtcaagagtggagtgcttcatacagctggtctcagaggggctcattgtcccggacctgcaggacaaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccaggcctttctccatgctgctgtcagagagatctaaacataggtggcctcctgcccttccctgaaaaccctttacggcctctgactgcattcagtgcaccctgcattcctcctgataaggtcttgcgtctccctgctgccccagcttcagccccaggagcctgcctgcccaggaggccatcattgttccccctggacactgcctgtcctgcctgctgccttgtcctcctttctccaggggcctggggcctcagtctctccatgcctgcacctggagtcctgttgcctgtgtcctacagtttcctcctcagccatccccacagggctgtgtccctttctactagccatgtttattttcttgtggagatggggtcttgctatgctgcccaggccggtcttggtctcctggcctcaagcagtcctcttgctttggccatctttagatgataactcactcacctgtgctgcctttcacttggaggatgggtggatgattcacagggacctgccctccttcccgcagagttggggtttttgtgtaggggatttttctgtcagttattttttcctcacctttcagagtattaaaagaactaagccattagtggtgaggcatgagggcagcgaccacagctccaggggagctctcttatccctacagctggcaaatgttccaccctgtttttatggcacacagaaaggtaggcgcatagtgatgttgttagtaagcttttgaagtagagcatggtgagttagttggcctttttacgaaaaaggaaatggaaaactagcaccatggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatggatgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatctcaaaaaaaaaaaaaaagaaaagaagaaccatactagtcaggtgctagagggcttccaaggcagcctccaagggaaggaaatgtctgagaagttatttaagaggatttgttggaacagaaaaacttccaaattggtctagaaggtggaccctagctatagacgcattttacaggacataatgtaaatattaaaggcacattttcagtatttggggaaaatatgtcctctgagtcgaatgaccaatggctgtttctagaaaaattttagttgtagttttaatttgattgtcttgagcatggtgatagattgactttttttttttttaagacagtcttacgctgttgcccaggctgcagtgcagtggcacgatctcagctcactgcagcctccacctcttgggttcaagtgattctcctgcctcagcctcccgagcagctgggattacaggtgcgcgccatcacacccagctaatatttatttatttatttattttgagatggcgtctcgctctgtcacccaggctggagtgcagtggcgcgatccctgcttactgcagcttctgcctcccaggttcgagagattctcctgcctcagcctcccaagtagctgggactacaggtgcgtgccactacacgcggctaattttttgtatttttagtaaagactgggtttcactgtgttagccaggatggtcttaatctcctgacctcgtgatctgcctgccttggcctctcaaagtgctgggattacaggcatgagccactgtgcctggccgcacccggctaatttttgtatttttagtagagacggggtttcaccagttggccaggctggtctgaaactcctcacctcaggtgatctgcctgcttcagcctcccaaagtgctgagattacaggcgtgagccaccgcgcctggcctagagtgactttcttaaagctctgtgtctcctggaaatggaatgtatcccaaatgaggattatttttaagctttataataaaatctttcacagcatagactttttttttttttttttttttgagacggagtcttgctctgttgcccaggctggagttcaggggcgcaatctcggctcactgcaagcgccgcctcccaggttcatgctattctcctgtctgtctcctgagtagctgggaccacaggcgctcgccaccacacccggctaattttttgtatttttagtagagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaatagttactgtctggctctttatgggaaaaaagtttgccaactcttggcttaaagggtcaagaatgctttaccaaaaaacaaacaaccccctcccccctacaactgtaatgtttgagcaggagttttacaagataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttataaagtagttcttcagaagtgtttgcagtgttcacaagacactggctctgtggtatttgacatgcagatgggcccagaattcctgacttaaggctaaagatttatcttgagcttatcatgatgtgggcttatgattgttttgatcagcagctgacatctgtgaagcctcagtgatcctataaattgaggaacctgagagaatcaagagaaagacaacaattcttgctgatgtcagtaactgtatttcacctgttaaacttctgcatggaggaggtcagtgttgtctgctgtgtcagcatcagcctacctgggtgtggacgtattctttgggagatgaaacgtagaaaaggtaccccgagtccattacacattctggattcccagaaataagacatctctgagggcagaacctttacagtcacttacatcaagaaggaattcttcaggagaaagctcggtaaaggtatcttaactttgtatgtatacccagagaaaacacataaagataaaaataaaataattttcctcattatccccacaccattagcatcttggtgtatagtctttgcatcttttttcagtatgtatgcacttagatcatcttgtaggacgccagtcccatgcattatacactttgtatctcacagtggagtggaggacagcctgatccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggctattcacaggtgctgtcgtactgccctggatgatagtacactgcagccatgaagtcctgggcttaagcagttttcgcctcagcctcctgagtagctgggacattaggcccgtgccgccatgcctggctcttgaccattcccacaagccacacctacaaggagctcaaggagctgtttgcgctgtaggcggttttttttttttttttttttttttggtttttgtttgtttttgtgcagaggtcagatctcttgtctcatagtgcaaaggcgatgaaggccttcattacagtctctcaatttgactctcagtttgatcggaagttgctaagatgggctgacattgtgaggaggatactgctacagcagtagtgtgtgtgtgtgtgtgtgtgtgtgtgtgtgtgtttgtacagactgtctcactctgccacccaggctggagtgcagtggtgcagtcataacttactgtaaccttgaactcgtgggctcaagtgatcctcctgcctcagcctcccgagtagctaggactgtaggcttgtgccaccatgcctggcccttttttttttttttttttttttttttttttgtacagacagggtcttgctgtgttgctaaggctggtctcaaactcctggcctcaagtggtcttcctgcttcagcctcccaaaacactggtattacaggagtgagccagagcacctggcctgaagctatatattattgttaactgcagtcatccgacagtgctatagaacactagactctgttcctgtctagctctctccccatttttcccatcctcctacccttcctaacctctagtatcctgtgtttacttttgacttctgtgagatcaactttttttagcttccacatgtattagtgagaacatgtggtgtttaactttctgtttttggcttatctcacttaatatagtgtcctccacttctatccatgttgctgtgaacgacaggatttcattcatttttatggctaaatagtagtccattttgtatagataccacattttcttcatctgttgttggacacctagattgattccctgtttggctattgtgaatagtgctacggtaaatatggggtatagatgtctctttgatgtcatgatttcctttcctttggataaattcccagtagtgggattgctggatcatatggtagttctatttgtagcttttgaggaaattccatactgctctccatagtggctgtactagtttacattcctaccaatagtgtgtaagagttgccttttctcaggccgggcgtggtggctcacgcctgtaatcccagcactttgggaggccgaggggggcggatcacgaggtcaggagatcgagaccatcttggctaacacggtgaaaccctgtctttactaaaaatacgaaaaattagccgggcacggtggcgggcgcctgtaatcccagctactcaggaggctgaggcaggagaatggcgtgaacccaggaggcggagcttgcagtgagccgagatagcgccactgcagtccggcctgggcgaaagagcgagactccgtctcaaaaaaaaaaaagttgccttttctctgcatcctggacagtatttgttattatttatttgtttatttatttagttttgaggtggagtctcgctctgtcgccaggttggagtgcaatggcacaatctcggctcaccacaatctccgcctcccaggttcaagcaattttcctgcctcagcctcccgagtagctgggattataggcatgtgccaccacgcctggctaattttgtatttttagtagagacggggtttctccatgttgatcaggctggtctcgaactcctgacctcagataatccgcccgcctcagcctcccaaagtgctgggattacaggtttgagccactgtgcctggcctgtatttttgataatagccattctaactggggtgagatgatacctcattgtggttttgttttgcatttccttgatgattagtgatactgagcattttttatgtatttggccatttgtatgtcttttgagaaatgtctgttcaggtaatccccctgccccggcttttttcttttcttttcttttcttttttttttgagacggagtctcactctgtcacccaggctggagtgcagtggtgtgatcttggctcactgcaacctccacctccaaggttcaagtgattctcctgcctcaacctcttgagtagctgggactacaggcgcacaccaccacgacctgctaatttttgtatttttaatagagatgggagtttgccatgttggccaggctggtcttgaactcctgacctcagttgatccacccgcctcggcctcccaaagtgccaggattacaggcgtgagccacccacctggccaatttgcccattttttaattggattttttttttttgctgttgagatgtgtgagttccttgtatatcaatcccctgttggatgaatagttcgcaaatactttctcccattctgtaggttggcttttcattctattgtttcctttgttttgctgaagctttttagcttgatataatcccattcatttatgtttgcttttgttgtccgtgcttttcagttactcatcaaatcttttcccagaccaatgtgatgaagcatttcccctatgttttgtagtagttttatcatttgggtcttatatttaggtctttgattcatttttagttcatttttgtataggatgagaggtggaggtctagtttctattttcactcttctgcatatggatatttaattttcacagcaccatttgttgaagagactgtcctttccccaatgaatgttcttggcgcctttgtcaaaaatcagttggctgtagatatgcaggttaattcctgggttttctattcttttccattggtctgtgtatctgtttttatagacacataccagttgttttatagaccagtaccgtgtcgttttgcttactacagctttgtagtatattttaaggtttggtagtgtgatacctccagctctgttcttcttgctcagcattgctttggctatttggggtcttttgcagtttcatacaaattttaggatattttttctatttctgtgaacaatgtcattggtattttgatggagattgctcttttaattatcttgatttctttttttcccccccaagacagggtctcacttcgttatctaggctggagtgcagtggcatgatacagctcagtgcagccttgacctcctggacttaggtgatcctcccacctcagcctcctgaatagctgggactgcaggcacatgccaccacatctggctaattttttgtacttttttttgtagagacggggttttgccatgttgcccaggctggtctcgagctcctgagctcaagcggtccacccacctcagcctcccaaagtgctgggattacaggcatacaccactgcacctggcctcttttcaatttcttgatggtgttctttgatgtacaaaagtttttaactttaaatgaagtccagtttatctactttttctttggcttattgtgcttttggtatccttttcttttcttttctttctttttctgagacagaatctcgcactgttggccaggctgtagtgcagtggcacaatcatggctcactgtagcctcgacctctagagctcaagggagcctactgccttagcctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaagaattatatagttttagttcttttctgctgtgatcatgtgtgtatgtgttggttttttatttttatttttttgagactgggtcttgctgtattgccaggctggagtgcagtgcttatccatagccatgatcatagtgtactgcagccttgaacacttgggctcaagtgatctttctgccttagcttcccaggtagttaggactacagtgcataccactgtgcctggcttattgtgtgatctattttgagtcaatttttgtggtgtgagataggggtccagtttcattcttttacatgtgtatatttacattttgtagttcatttgttgaagggactacttgtattagtctgttctcatactgctataaagaaattccccagactgggtagtttttaaaggaaagaggtttaattgattcacagttctacatgtctggggaggcctcaggaaacttacaatcaaggcagacggggaagcaggcacgtcttacatggcagcaggcaagaaggagcgtgtgtgagtgcaggaaaaactaccatttataaaaccatcagatctggtgataattcactcactgtcatgagaacagcctggggacaccaccactataatccaatcacttccttcccttgacacatggggattacaattcgagatgagatttgggtggacacagagccaaaccgtattactattctttctccattgaatggtcttggtgcccttatcaaaaatgtattttccataaaaaaacaccaattgaccataaatataagggcttatttctggactctaaattctatttttttttttttaagaaacagggtctcactctgttgcccaggcaggagtgtagtgatgccatctcagttctcttcaacctccgcctcctgggctcaggtgatcctctcacctcagccccccaagtagctgggactacgagcacatgccaccaccctcgcctaatttttgtattttttgtagagatggggttttaccatgttggccaggctggtctcgaactcctgagctcaagcagtccaccctcctcagcctcccaaagtgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagtttaatgttgtgttaaataatacacagtaaattttactgacttctttttactctttaattgtagctgctaggagatttaaaattatttttgtgattctcgtatttctgttggaccagaggtattttttaatagcatgacattctgttacatggttgattatatgatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaacgtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatcaagcaggatgggtgagacttgaccactggattttgcaacttgaaggtctttggggacttggacaagactggtgtcaggaggcatgacaagtggaagttttcaggggagaatgggatgtgtgtgttaacagcttcttgaaagagttttctctaaagtagaatgatgggggagtgggggtgctggggacacattagcacttaccgtgctctggaaggcagggtgttcaggagggaggttgacagaggagggcctgggatccagtgccagagtagagggtggaccttgcccatgggatctggagggagggcagagtagacaggcaggccttcctttcagcagtgggaggaggagaaaataccagcttgcccctttccaaaagctgagagtaagggtgacaagggggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgagaagccacttcattattgtagtctattgttacgttgttaagtctcacccaagtgagtatttaaccttaaagagtttgagattcacttgcctattttgttatccataatagagcttttgcagctgctccaaatatccctccatttgtgcatcttaatagttgtttggcaatcaccttattctgcactgggaaggctggagaggggtggggagctgcggggtgtctggaggcagtatggcgagctcgagattcccaccctttcagagatgaggtggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttacaatatttaacaatcagtagagattaaaagctgtttggcctctttcccattgatcacatagcctttttctttttgtacaattttagtatgattaaccctcccacccccattaaagttcttcagccttcttagtagaaagctctgtgaagtttgattcacccacggaagttacttcatggagtggaagcatttgagaaatcagatcttggctttcttcttgtggacagatcaggtggctgaggcctggagggagcttgatttgagatgagtagtttgtatgcctgactaagtcaagtagccacttacttcccttcacacttaatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccatcaccccagccctgcatccttctcccttcccccaagaccccctcccctgccactatgctctgattcctagagcggtgtgtccctgtcctgccactcttgctgtgcctgtggctgtccctgttccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtaccgtatagtataggacatcctaggcagcaccatataatcaagcacattaagatttttgcagcaaaaagtatatgaatattcacactaagtgggacagtgagactatgaatagcttcacatcagatcagggcataccgccaagtgagttatgaacatgctttcagttttcagagagctttttggattttcaaattgcagagaagggattatggacctgtcttagtgagcatctgcttgtcacgcattatgcagcgtgctgaaatacaaaggaagaaaacatcacgcctgccctcccgtgtagggggtgggtggtcaccacatgcgggtggtgagcccatgctgggagggcactcccggcaggtcctgttgttctccctgtcatctccccctttcctttgcgagcgtcctctacaggtgcggtttcaggtgagccacatggggggctggcagaaggggcactgcattgtgacgcagggtcaaatgtgtccctctcagagtgtaggaggtaaccgttctggatcgcctggatcctgcccttgggtctggctgcccgggtccaaggaggaaagggccgactccaggtgatgctgcagaccaggagcgctgccctcacttcctaaccttctgcacttgggtgccggggccccctctctgcagtcacacactctgccctcttagctgggcctagagctttaaacattaactggattcaacatacgtttttctgactttttaaatataatgagtatagttttattttaatgtttttcagatgcattttgatgtaggtaggtacctttacattttaaaaatttatttgctttctgaaatgggaccagcatatatatatatatatatatatatatatatatatatatatatttttttttttttttttttttttttttttttgacaggttcttgctctgtcacccaggccagagcacagtggtgcaatcacagcgcactgcagtgcagcctcaatctcctgggctcaagcgatcccccacctcagcctcttgagtagctggggttataggcacccaccaccacacttggctaagttttaaaaaatttttttatagagacagggtctcactatgttgactaggctggtcttgaactcctgggttcaagcagatcctcctggctcagcctcccaaagtgctgagattacaggcatgaaccaccacaccctcctggtacctgcattttgaaaatgtttcattgccaagcctgcagggaagtctgccctttttttattagaaaatgaagagctaattctgaaatatgcctactaaatatgcatatctcaagcactttaaaaggatgtagggtgaaatagtctgttcctgaagcaaatatcactgtgtgttcattccattatttccgtagcttttctgtggcttttgataagttgtgtagaatgtattaagtctcatctgaaaatgtatattaaagattgttcttttaatttaaaatgatttgtccaaggtacttgacttaatgattcaagatttaatgagccgtgacacttttagtaacaccgtctcaatctttcagattttataaaagatattaaagttttcagaaagttgagaatggtcttttgtaatgtattttaagatagttaagaatagagtttatataattaagattaggatttgtattgcaaaaactcccttcaagacgcattttgggcctttatgagcgagtaatcatgacaggacagagtggcttcacccacagttttgtggttaatatttgcaagtcgtttatttaacaaggttgaaaagaggcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcgggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtcaatatgcagattttctctatttagtatttaagctatgaatttaccaatctgagtaacttgaaatgcagtatcataaaaagaatcagatctaccaaactgaaaatgtgtgcgtatctaaagtagtttcttttcttgattttggttaagttaacaggagtatcttcacatctgtaatttctggtaacttaatgagaacacactgaacttttgggtcacaataaattttcccattatgtaaaatattttacacaccggttgactcattgtgaattgtgagtcgacatgattctcttcctgcggaaaacagaaacacatgctggccgggcgctgtggcttatgcctgtaatcccagcactttgggaggtgaaggcgggtggatcacctgaggtcaggagttcgagacccagcctgaccaacatggagaaaccctgtctctactaaaaatacaaaattagccgggcatggtggcacatgcctgtaattccagctactggggaggctgaggcaggagagttgcttgaacccgggaggcagaggttgcggtgagccgagatcacgccattgcactccagcctaggcaacaagagtgaaactccatctcaaaaaaaaaaaaaagaaacacatgttattgtaatgatgatttgagccaattacaggattgtgcttatgttaccacattgactaggtgctttctgtgagttgggttgttgaagagtttgaggtagacagatggcagtgggtgggaatgagcggggagcttttgttaggtttagggaatgtggtctttccaccatcatttagttgtttattttatgcataggcttattttcgttcttgtgagcattatgttgagttaatgtgttttctttgacctcaaaccttctgaaatgtttctgggtcttaaagattcaggtattatttatttcatagtagacagaatcaagtaaatgaatactttcttgggggagagtgttgataagttccatagcgacacctctccctcatgattaaaagtgctacatttgcacaaatatgtgacttatattttatattaaaattaagatcaacttttttcttgagaagttgttgaacttttagatttgggagagggggagttctcacaggaattatgaattgttttgactagtgagaagcttatttaacatttttggaaggagtaccccaaaagtaatgcatcttttggcatagtggaaacttgcagtaacgttttcttgttgttttttaattgattgggtgacctgcatctcattaagtggtgtctattggatgtttggcctttggcttgattgtgtccgcttttaaaaaataactttattgaaatcgtcacattccatacaattacctatttaaagtgtccatgtctgtggtttttagtatattcacagagttgtgcagccattgcctactttggacattctatggaaatgcggttgacaggatgtgttttctgtgtgcagtctctgtcactaagcaccatattttcattcatattgtgcatgtatgcatcggttgttccttgttaatgtcgaatattattccattgtgtggatgttccacattttatgtatttgttagtccattgatagacgtttgggttgtttctactttttggctgttgtgtgatagcgctgctgtgaacattcatgtacaggtttttgtgtggacatgtcatttctcttgggaatatacctaggttgtttgtatctgcttttgctgcttcttttacctacagttcagattcccatttatgtttgtacagacagtttgctacttgtgactggggcttgtttgacctttgttgctgacctagcgacttcttgtgtcatgtttaaagcccctgagaccctctgttgcctagagaaacaggcagaattgcagtctctttccttcctaagaccagatcacatctggtggtcatgaaatggtcttatcctgtatagatttttggtaaataagtatgtatctaagccaaataaattttgtgtgtattttatattatttttcttctctctgcttcctcttggggacatcctttgttctgtggccccagtggcacctagagtgaatatgaatgatttgtctatgttttcccttcaggcggaatgccgattacttggattttttcttgttaattttggtgactgagttgcctgtttttgaagtgaaaaatacctgcagatagtagggttgccctttagcattttaagtgtctaaatgagacctattgggatgtttccatagtttgcatcaaattcatgtaaatgcgcgttaatgatgttagctagtctgcctgagctaaattactaatttcattactactatttaataaaggggcaggatttgccatggtcattctagttaatggtaagagccctgtaggtctctcatcatatatctaagctgaattaaggttgaaaatattactgagtgccttgtggctctatttggtaacagtcatgccttacattttgagacagctaatccttttacacaccaggtgactcatgtgaattgtgagtagacacgattctcttcctgcagaaagagaatgcattcagtcagttgaaaatcaacatcatgtggtttgtaggataggtcttactcctttcttagacaaggaatctgggatccagaaggagtgagcggttggttaggaggagtcagtgccagagggaggcagcatgccctttctgctctgcccacgctgtgaggacaccgggccgtgccttcgccaggaggaggtcatgccaagtccaaagcgtcaggccgctcagagccaagcagctttgctggagcacccactggtgcacttggaaagtgatttctcctgttaaagcctcgctgccacctcaactgtaaactggagacagtaggaagccaccttcacaggcctgcggggacctggcacccgtgcaccaaaccttgctgcccttaatcagatggtcgaattgagaggcagttggaagggtcctgtggtgtgctccttctgggaccttctgccaccccttggaggcaggttgcgcccctgcccgtctcttcccaccagtggacactcccttcagccctgggccagctgtggggccctcctctgtaggcgctggctgttccaggaggcacaagagtgttggtgtgggaccttcccactgctcgagatcccccacggagagcccactcaggctacgcttgggcttctggccgtgtgggtcagcgtcacaggacggacagatcaatgggggaagagtcatcctgcagcgctgccaccactggaggctggtgagagtggcgctgccacagagaacaagccttgatccctgacttgaaagtcagagttcttctggaacttctgtggggagtgcccagagtggcacctaaatacgtctagaagcgcttgatgaaagttcctctgaggcttttaaactgcttgagtgagtctctctgaagcacggtgatggcaaaaggaaaccacctcacgctacctctttgtgccttctcttctctcctcatctcctgtaggccgtaggtgttccctgtcaggaatttacgcggaggcatgtctgctgtggccaaatgtgttcattcattcatatctcacagtaagagggaaggatgggggaggaagactgctgtatttccttaaaagtttttctgtaactcgaatccctcccacccccgtgaggtaacaacgtcttttccagttggtgtcagtgaactctgttttgggtatctacaaaagcagaaggggaggttaggatgtggctggaggaggctggttcctgggtgtaaatcctggctcttctgcttgaactgactgtgcctcagcatcctcgtctgtctggtggagccgcctcacagaggaacaagtgagttgtgcgtgtggagcaggtggctgacatgtggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcagaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgccttgggcaaatggaggcctcaggtcccagacataggctctgtcagtggtggtggcggtggctgtacctgctccgggctgctgtgagggagggacgggctccggccacaggcgtgcaaggtccccttgcagaggacctcccgcacctgctgaggaatgtgtacagccatctggagggtgttctccccctggccctccctgtagtccagctgagtccacgtccttcagccccttttcaatgttcctttctcacagaaccttgtcctggaggtgcactcgggcccgggttcttcctcctgtgcggtgccaagccctcctccaccacgcatgatggtgtgttttccatgactcttcctcctagagcaccggtgcccgccctgacggcggttccccacagtcagattgagtatcccttatctgaaatgcttgggactagaagtgtttcagattctgatcttttcggattttggcatatttgaatatgcataattggatatcttggggatgagacttaagtgtaaacacaaaattcttttcatatacaccttatacacatagcctgaaggtaattttatgcaatattcttaaatattttgtgcatgaaacagagttttgactgtgacccgtcacgtgaggtcagttggggaattttcctcttgtggtggtatgttggtactcagaaagtttcggattttggagcagtttggatttttggattagggatgctccatttgaatattctttttatatacagcacatggtcagtgctcactaaacttagtattgcatgaatgaatgaaaaccaaaggtcatttactaagcgtgctactatttcagaagcctctttttcctgatttggttctatggtcagtggtttaatatttcaagtgctctgaccacgtaatggttgttaccacactgtgaaggtggctgggtgttcagtgattgctgcccacagaggacctggaagtgcttgctgtacttggttttctggaatggaaatcatggctcattcccaggagcccctcagcaggggctttgagtctggtgctaagcagcagatgtgcagattcccgcagggcgtacctgagcccggagagggggcgtcgtagcgcacagcgcactcgtttccgcattcccaccccgcacggccagttgtcacagccatcctccagtaaaaaacacaaaccagtcaacctctaggagacaggtaggaaatctagaagaagcctcaggtgttcacagcattttttaaagattctttaaaaatcttcgtgattggaaagactgcttcctgtgccagagagtctctctccagcgcttttgcttctgaggttggtagctttcagaaagactgcaatgcagcggttaccaaagtccttgttaatatggaaacaactcgtggtgaagccttttgctccccttcacaactgctgactgttgcctgcagtcggaaggaggagataatgaaggtaatactcctccggacctggcagtttagtgattagaacgtacgcgattctgtgaatgctgtggctggcacagcatgtcctgcagcagctctgtcaacttactgatgcagtgggcttcctgggaacgtgaagctgaagatgtctttgcagtttgtgcacgataattttgttttcatctctgtgttcagatggtggattataagaaggtaagggactttacagatcatgcatatatgtattttaaatgtttatgaatatccctaatcaaggtaaagaattatgattgaatagacctcttttgaacctaagaaataaaactttatttcttgttaatgacccttttgacgtttgaagacttatcttatttagtcttgacaaatgccctatataagtgaattattgaagatgttctttgaagagatctgctttttctttgatttgctaaacgtagttggtttcagaggtgtagatacgcatagaatatattcatttctttaacttaagcaatgacagttacattaatctggatggaacttttcgtcttaaaaaatctcagccactggctgtagatgatgaattctaatctccttagttcttattttgcctttagaagagcattttcagatgtgtggagctctgtgtttatccgtggggtgagctgggtgctacctccagctgctgctcttcgtttatcttagagggaggccaagagtcagagcggagatttattttgcaatgaattagtggccccaaacggtattaaatgcattatgggtggtaatttatatgtccaatgccaagaaatataatgttggggttaccatggcaactgcttgcattctgaaaagcttgtgaatgggttctgaaccttctggcattggaagtgagcttttccagctgagggcctgcattcgtgattagtgtaaataaattcagctttccatatgaagcacatcctttctctttgtttaccagagtagtccattgagctcagttctttctctggtgatgtctgccttggtctcttggttcctggcaacagaatatggttgagacatagttttcaacttcaggctgaggaactagcctgtgtgtgtgtgatgacctgccacctcagtccatgcactgtgtagaaggggctggctcatctgtacctcctgagggctggcaatgcatgatgtctccaaaagcacagttgcagccgcatgtgctggtgggctcctggcacagctttctatccatctgaagggcttgtttccggtaacacttgctagggctcttcctgggaggcagccctgcctgtttccagggtatcatggggattggttttggggagggaggcccaagttagaaagacccatgtttaaaatgtcaagcttgtgaaaatgataaacgagggcctattgtcttcattgccgaagatctgtttgctgtttgttagaaatatatgtagcataggccggggatggtggctcacacctgtaatcccagcactttgggagacgaaggcaggaggatcgcttgagcccaggaatctaagaccagcctgggcaaaatagcaagacctcatgtctacagaaagataaaataaaataaataaataaataaaactagtttcccttgtgcatttaaaacaatgttgacatcttgatggccagagactgaaatgtctgtgtgtgatttcaggggcctgaggtcggaaggttggagcctggtggttgctgccgaggcggcagctcctagagggcctggccagacactgggagaatgttttcatgctctgtagaattcattctctttgttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaattgatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgttcttacagagaagctgcagtgcccagcagttacccaggggtgaatctgaatcaccacctgttaaatcaaggtcatgatactgtatttactaaggcaggacaacatagtaatttaggctcaacttacaagttgcaacttattacaagtaataagaggttcggcttacaaggtttgaaatacaaattgatttttttagccagattccattgaaccctggtttttaattttccaatcttgaaagaagactgagattttactgtataactcacttagggtgacattgtgttttcctaagtattctcagtgatttctcccattctccctattcttctcacatgggactttgacagagagctgcacctgggctgggtgtgtggcctccctcacccagcagtatggcccaatggtgctatgtgactgctgagttaggtccttaaaagggtgcagtttttgcctggatgttctttttggggtacttgtttgccatccctatggtgaggaaacccatgtcgcccacacaggaggaccacacagtgagcagggcattgacataacaaggtgacttctgttttctgagtaacttccaccacagtggtgaaactgtgtccccaagctcagcaggcggaggtaaaacatttttcaaagaaaagggtaagataggctcttggtttaccacatggtgaagagaggcctctggctcttccaaactgttgcagatagagcgtggagtgctgggacttcggtcaggccaggtcctgccgcctcactgtccagctctcctgagtgctcctggtctgccttgctctctgcccagtgctgcctgctgcccgctgcccttatgtggagtgaccttctgtctcccagccccagccatgggtcccgttgcccagaatacaagagcctttcttggcttagaactttaattcaaaaccctcagttcttagagggtttgttttccctttttttttggcctgggattttgagaatatctaatagtgctgggcagttttatcattcatcatcatgggtagtttggtttattacaacttgcagcttcatatcttgtaaaacaaattcatttcttgctttcagatttgcttatctaaaagttttgttcataatagtaacttagcacaaggcttctaatatatgagttgatgaaaagcacctcctgtatcacctttaataaggataattttgaagtgtaatttaatgcctggaagccagttggtactgaggtttaattttgtacttgggaaagaagtgtgagaagaaaagtatccttttttccttaaatttatttttcttagttgacatataaaattgtatatatatttatcatgtacaacatgatattttgaagtatatatattatggaatggttaagtctagcaaattagcaagtgtaaagataaactcacagttatctttttttgtggtgagaacactttacattttttctttcttttaaacataaaatctttcagaaaagacgtctactttctcagcatttttcaagaagaaaagtatctttttaacaaatacattttctaagccctggtctgcaacccactccattcagttaatatttatcaagcactggccgggcgtggtggctcacacctgtaatcccagcactttgggaggccgaggcaggtggatcacctgaggtcaggagttcgagaccagcctggtcaacatggtaaaaccccgtctctactaaaaatacaaatatgagccgggcatggtggcaggcacctgtaatcccagctacttgggaggctgaggcagaattgcttgaacccgggaggtggaggttgcagtgagccaagattatgtcattgcattccagcctgggcaataagagtgaaactctgtcctcccaccaaaaaatatatatatttatcaagcactacctacacacacacccactctctcttatacacacacaaacacactaatagacatagcagtaatatatattaagcatgaatacagcaagaagtttggtaccctagaattagaacgggtttttttttcgtatataatctacaaaatgagatgttgaattgatgtttaatactaagctacttcttaagcatttgatttttcttactgcatttacctatgtttataattttaaaatctgagaattatagaaaatacgtaatttctacttatctttcagattatagcttaaatgtcctctcctggggtgggggaggtccccatatccacataaatgggtgtgacctccatgtgcactgtgcacttccctttggtacttttcgtctcacacacatgcacaccctgcacagacacacacactcttattgctggtgttctgtcttcttgcctgtggactgtcagctctgtgaaggggaggcttctgtctttcttgtccctctcccttctgtggcactcagtacatgttgggtgaatgaatgaatactggacacagacgctttccttgaaggtggttggatgatctaccctttccttataggactttttcagatgttttcaaattcaaccaagaaatcttttttttctattactaagttactgtttttccaaattattgaatatttctattttctcctgcctttaaggagtaggaaacaactaagaacagatgatgtctcatgttgcgaatggatccttccttcctttgcttttccctcaagttctttctcatgcaagcgaacacccatattgtgaggggtagcaaatttaaatgagtcctttgcattcgagtatagagatgactgaggagaatgaggtagtttggaaacactagaaaaatctgcctcagtgcttttgatattttaatttataggcaattcttttaagtttcatttttctcaagacaaatgccagactgtggaaagggtgctgtcatttaaaaatattcgggcatgtggccgggtgcggtggctcacgcttgtaatcccagctctttgggaggtcgaggcgggtggatcacgaggtcaggaattcgagaccagcctggccaacactgtgaaaccccatctctactaaaaatacaaaaattagctgggtgtggtggcacctgtaatcccagctactcaggaggctgaggcaggagaatggcttgaacccgggaggcggaggttgcagtgagccaagattgcgccactgcactccagcctgggcaacaaagctagactttgtctcggggggaaaaaaaagaatatttgggcgtgcatactgcccaaagcgatttacagactctctgctattcctagcagattaccgaggaccttcttcacagaactagaaaaacactgctttaaaattcatatggaaccaaaaaagagcccaaatagacaaggcagtcctaagcaaaagaacaaagctggaggcattctgttacgcaacttcagactatactacatggctacagcaacctaacagcatggtacgggtacaaaagcagacacgaatggaacaaaagagagagcccagaaataaggctgcacacctacaaccatctcatcttcgacaaagctgacaaaagcagtggggaaaggactccctattcaatcagcggtgctgggacgactggctagccacatgcagaagattgaaattggaccccttccggctgggcgcggtggctcacgcttgtaatcccagcactttgggaggccgaggtgggtggatcatgaggtcaggagatcgagaccacagtgaaaccccgtctctactaaaaatacaaaaaaattagccgggcgtggtggcgggcgcctgtagtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaagaaattggaccccttccctacaccatgcacaaaaatcaacaaaagatggattaaagactgaaatgtaaaacccaaaactataaaaaccctgcaagacaacctaggcaataccattctggacacaggaactgacaaaggtttcatgaagaaaacacaaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaacttaagaaacttaagaactacaagaaaaaaaacaaccccattaaaaagtgggcaaagggcatgcacagttagttttccaaagaagatgcacatgcagccaacaggcatatgaaaaacagcccaaatcactgaccattagagaaatgcaaatcaaaaccacagtgagatagcatctcacaccagtcagaataactattattaaaaagtcaaaaataagatgcttattttgagggtatggagaaaagggaatcctaatacactgttggtggagtgtaaactagttcaaccattgtggaaagcaatatggtgattcctcagctaaaaatagaactaccatttgacccagcaatcccattactggttatatatactcaaaggaatataaattgttctaccataaagatatgtacacatgtgtgttcactgcagcactattcacaatagcaaagacatggaatccactgaaatgcctgtcagtggcagattggataaagaaaatttggtacatttatatcatggggtacgatgtaactgtaagaaagaatgagatcctcctgtcttttgcaagaacgtggttgggagctggaggccattatcctcagcaaacgaatgcaggaacataaaaccaagtaccgaatgttctcacttataagtgggagctaagtgatgagaacacatggacacaaagaagggaacaaccgacagtagggcctacttgagggtggaaggtgggaagagggagaggatcagaaaaaataaccattgggttctaggcttcgtacctgggttacaaagtaatctgtacatcaaaccctggtgacaggagtttacctgtataacaaacctgcacatgtacttctgaacctaaaataaaagtaaaaaaaaataatttgggcacgatgactcatgcctggaatactagcatgttggcgggaggatcgcttgaggccaggagtttgaggttacactgagctgtgattgtgccactgcactccatcgtgggtgacagaacaagaccctgtctctaaaatatttatctacatgatatatacatttggtgggtgctttggtcccaactgtctgtgaccatctggggcagagccagtgccgtgtgcaaggtgtactgcctgcacacagcacaggaggctggggctggccagggcctgtgcacctgctcctctgtgcctggcttgtggatgcccctcactcgctgagtcttttctgaagtcatttagcagcactgccactgctctaacctacatttaaagatttattttcataattttctggcagaaaattttattaatgtagccattttatttgtataatgattgttgagaatagaatattttatgttcaagatattgattaatttttggagaaactaagaaatttgatgttgcataacaaatctctatttaaattcacggtgtaaactgcagtgaatcattagtgtattaggtaaaagccaacattgcagaatatagtttatttgaaaggccgcttagatgaaaattctagggtgatctggaaatgttttacacttttgtatatgtgatcattggatgctacttaggagagtttgtactagtgtgtctagcagttgtagcaaggtgaggtgggtggccacatttgattatgaagtaaatttattctagagagtttatatagcatgaagaatattacaatcaaagaagtgttacactacatatcttaaacttttaacatgactcttatctagctataaaaatatgtctgacattttgtgttttaggaatgaagtaagtatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataatttaaatgatgtgataaattttattttagcctagccgagatcttaaaatctattttgaagtcaggcactagccttatttggttcagctaaaggtgctccctggtgcatcaggttgtgaatgtcatatatgagtcctaagggagtaaacaaactctggctgtgtcagtgctgaaattcaaaacagtaaaaaaaaaaaagatacttggttttaaaatggggtggatgcatctattgggctttattgatattttggaaattttgagatatgtattttgcctcttgctaaggaattagataatcgtgcagggtttgaattgacagttgtcaaagtcagcaaaaatactatggtcaaattgctgggtctttgagacctaggttttagtcctgttagctctgactttgggcaagttgtttgatgtaattgttttagttcctcaacaatccagaccctggccagcagagttggagcattgaatgatctttctaagataatttgagcgtacaaatggcaaatctgatttaacagcataactgttgattcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataactacaagaagtaaattaataactaagaccaaatgcatactgtgtggccagcaccattgtaagtgctgaggatacaaacctgaacaagacacattgctgtcttcagaaagctcacagtcagatgggagagagagaaggaagcaaggcaagtacaggcttgtaagtgttgtgatgggtgtccttacaggaccaggatttcaggaggtaaggtcagtttccctgggaagggagagttagagaaaagatgctcgcagtttaattcaacaaacaagtggtacctgctgggtgtgcctgccgtcctgctaggcattgagactacaggataaatttagcatgatccctgctctaaaggagcttaaagtttagtggaaaaccatgagtctagtgataaatagtagttgtcaagatacttgaatggagtcttgcagatgaagtgtttgacaggcagtggaagaacaaaaacacagaaggagacagtcgttgcggctggagcagagtttgcaagtccactcctggtgagggaggggatgctgagccagcagggcagggtctactcacacccagaggctggctcggaagcagcagatgtaaagggaagtgtgtattggagggggtatgttgtgaatttgatgacgtctgattgttacattgaattccatgagttctagacaatttcttcatgataattacccccttaaatttcataatcttcattcccccactaaatttaataccataacatttttaatttaaaaaacaccttttttgtcggtacttttgaaaacattttcctgcacctgtgccttctatgaaatgaacgctgtagagaatctgtggaaatcggctcatggtagaagctttccctgtcatatggatgagtccttttgcttgcccagtgccctcctggcatattgatgaggtaggattgggagttcggaacgcctacaaaatgagcaggctaatttcgaacggatgctaatcctgcaaaaccaagagagatgcttattggttgatttgccttttttttttttttttttttttttttttgaaacagtctcactctgtcacccaggctgtagtgcagtggcgcgatcttcgctcactgcaacctctgcctcctgggctcaagcgattctcctgcctcagccttctgagtagctgggactacaggtgcacgctaccacttctggctgattttttgtatttttagtagagacggggtttcaccttgtgggcctgactggtctcaaactcctcacctcaagtgatccgcccatcttggcctcccaaagtgctgggattacaggcgtgagccactgtgcccagccattatttgcttttagttgaatttgtgtgtttggagactgagcacttactttcaacagtgaagaaattgacttggcagcagttgctgcaggtggctgttttcggtctacctcatactgtcagtgtgtcgcccagatactatataattactcagttattttgcagtcacaacatctttgtgtgtttgtatttatttagtaattagaagaaagtttttatgttctcatagtatcttcctgtctacacagtgcatttgtttactaatttatatccatttgatacacatctaatgattgcctctgatgggtatatgtgggaacatgtacattccctactgttagctgcaaatagtgagaagtagttagagcataatgtttcacatcgaagtaatctctttttcaaagacatctctgagaatgaaaacattaagtttggcagttccgacaaactcttatagtgataaggtattagtctaattctacttagtaagaaagttattcccggagacttccatttccactatgatggaattagaggtgatttacgccccccaacccaggactagggtaaggcaagtgaggcacttgcctcagtgcagaatttaaagggacacccaaaatctcagtaatcgagattattaatattttaatgcagtgctttaaaaaaatcaaatttgatgcaaaaaaaatccatgatgaaaaacaaaattattttttactttttaagacagggtcttgctctattgcccaggctggagtgcagtggagcaatcatagctcactacagctatggtaatacagatgggtgggctcaagtgatcctccagcctcagcctcctaagtagctgagactacaggcacatgccaccacgtctggataattttttatttttttttgtagagtggtgtctcactgtgttgcccatactgatctcaaactctgagctcaagcagtcctcccgtcttagcctcccaaagtgctgagattattggagtgagccaccacgcctggcccaaaacccaaatttgaaagacaggatcagtattaatgatttttctttttgtctcaagctccagcatggcttggcaagacaccattatcgatattatatataaaactttggtattttgtacctcgtggattttttcattaattttgattttatctctattactgagtttttttgacactcaattaagatttgtgcctaaggcaagtacctcacttggcttgccctagtcccaaattgacttctatcttaaacaacttgaaaaccagacaaaatatatgaagtaatagttttcatacatttgacagaaggctggttaggaccatgttccttgaaataaggggaacaaacaaaacaagccctgcagtattccagcttataccccacagcatgagactgcacttttttctataaagggctgtatagtaaccattgtaggttttgggggccggatgctgttaatgtcacaactactctgctatgctctgtgcctgctttcatcctaagtatgtaagtgaatggacgtggacgcattacaataaaacctttctgacacaaacagccttagtttgtctcgagaggcagtttccatgtttcagggcaggaagagagaagtcaaacagaacccactggcttcactaaagtgatgatacaggagaaattggggaggacaagacagctagaatttgtggaggaaaacataggagaggagggagcaggttagagagagagctctagagatctgcagaagggcccccttgaggcgttggctgcatcctggtctgcacgtggccaagaggaagcacctcaaggctgggaggagaaccaccaaaaaggagaaggccaagcacttcttggacatcagttgcacagggctgggaatagtttgtgttcccaccacccagggtggtctcaggtagatcctttgaagggttgccttttcatctttgttagcgtgggttcagagcagctttttcatctatggtgtcaggacgattcctcagaagggctgccttagcagtggggctgagttatccatagaccaatgggctgctcccgacttgccctaactgattacagatagcttgattacattatcagaaccaaagccccgactatatttaaaaaggatgtaataaaactagcacccaaaaatgtaaaaagaaattgtgtctagcatctaataaataattaccaggtatgcagagaagcaaggaaatgtgatattaaccaggaagaaaatcaagagaaacagaacccagaaagacaagggatgatgcaattagcacacaaacattaaaataacttataaatatgttgcacactcaacataaaacgtagagaaaaacataagcatactgagtgaaatgaaagactcaaaaaagattgaaataaaacttccagagatgaaaatagaatatatacaatatataaaatgccgggcgcagtggctcacacctataatcccaattctttgggaggctgaggtgggcagatcatttgaggtctggagttgaagagtagcctggccaacatggcgaaacctcgtctctactgaaaatacaaaaattagccgggcgtggtgcaggcgcctgtaatcccagctactcgggagactgaggcaggaggatcacttgaacccgggaggtggaggttgcagtgagccgagatcacaccactgcactccagcctggcgacagagcaagactctgtctcaaaaataaataaatagataaaaataatatatattttatttatataataaaatatataataaaataaatttatatatagtaaaataatatatacacatgtatatgtatatataatgcagtagagggatcacaacaggttattacgacagaagaaaagagttcatgagcctgaagacgtagcagtagaagctttccaaagcacagcacagagaatccagactgcgcgagatcacagagcatcagcagcctgtgggacaaagtcagctgacttaagatatgtataacctagttccagaaggagaagaggagggaatggaaaaaatatttggagaaataatggctggaaattttccaaatttgatgaaaaatgcaaactatgaagctcaaaaactccaaacagagcaaatataaagaaatccaaggtacctcataatcagattgccagaaaaccagtgatcaagatcaaaagctttcaaagcagccagaagaaaagacacattacagaggaatacagttgctaataacagcgattcctggtcacatcttgtgtgaaccagaagacaacagagcaacatattcaaagtactgaaagaaaaaaacctgttagagttctgtatctggcaaaaatgtctttcaaaaatgaaggataaatttttatttatttcagaagtaaagaaatttttaggccaggcatggtagctcacacctgtaatcccagcactttgggaggccgaggtgggcgaatcacctgaggtcgggagtttgagactagcctggccaacatggtgaaacctcgtctctactaaaaaaaattagctgggtgtggtggcaggtgcctgtaatcccagctactcaggaggccgagacaggagaattgcttgaacccgggaggcagaggttgcagtgagccgagatcgtgccactgcactctagcctgggcgacagagggagactccatctcaaaaaaaaaaacccaaaaacaaaaataaatttttaggccaatagacatcagaatttattgccagcagaatggcactaaaggagtattaaaggaaattcagatagaaagaaaataatatttgatgggaaaaatttttatttatatatattttggagacaggatctcactctagtgtccaggctggagtgcagtgggtgtgatctcggctcactgcaatctctgtctcccgggctcaagcagtcctcctgcctcagcctccctagtagctgggactataagcgtgtgccaccatacccagctaatttttgtattttttgtagaaacggagtctcactgtgttctccaggctggtctcgaactcctgatttcaagcaatccacccatctcagcctcccaaagtgctgggattacaggcgtgagacactgcactcaggcttaaatagtcagtttccatctggggccaggcatggtgtctcacacctgtaatcgcagcactttgggcaggaggagagggcagattgcttgagcttgggagtttgaggctacagtgagctatgatcacaccactgtactccagcctgggtgacagagtgagaccctgtgtttctaaaaggaaaaaaaaaagtggtaaaattgacaaagctccagtgaaactgataaggaagaaaaaacagatataaataatgaaatgaaatgaaaaaggtgaaaacactatggattcagtagactgttaagatatcataaaaggatattagaattagcatcacgctatatacatttgaaaatttagataaaatagacaaatttctttcaaaatgtaacttaactaaaagtaactgaagaaatagaaaaccttaaccagtcctatgactattaaaaatgtttagatttaaacaaatgtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcatgtgttcaggttctttgggaaagagggagaatctctataagtcccatagtgggaagaggagacccattaatcctgacctgggttgtgtgttcagagatgagccaactctgggcaggaaaataagatgctctgaatgaccaggtgcaaatcacaggctttacctgggcccaggtgttggagtcagcgcccctggaagctgtggactgagctgggaatttatacctgacaaggatcagggtgcaggaaccatggggaaggtgaacaaatatttggctacaaaattaaatctccattgcagtaattgccagatgtaaaatttcatgaattctttattcaaaattatgatgaaattctataataaagaattcttagttggccaggtgtggtggctcatgcctgtaatcccagcactttgggaggctgaggcgggagggttgcttgaggccaggagtttgagaccagcctgggcaacatagtgagactcccacctctaaaaaaaaaaaaaaatgttgtttttgttttgttttttttgagacggagtctcgcactgttgcccagactggagtgcagtggtgcaattttggctcactgcaagccctgcctcctgggttcacaccattctcctgcctcagcctcctgagtagctgggactacaggtggctgccagcacgccggctaattttttgtatttttagtagagacagggtttcactgtgttaactaggatggacttaatctcctgacctcgtgatccacccacctcggcctcccaaagtgctggaattacaggcgtgagccaccatgcccggccctaaaaattttttgtttttttttttgagatggagtctcactttgttgcccaggctggagtacagtggtgcaatcttggctcactgcaagctctgcctcccgggttcaagtggttctcctgcctcagcctcccggttagttgggattacaggcgcacgccactagctctggctaatttttttatttttagtagagatggggtttcaccatgttggtcaggctggtctcgaactcctgacctcaggtgatctgcccacctcagtcttccaaagtgctgagattacaggcatgagcaccgtgcccagcctaaaaataaaaaaaaaattttttttttttttcaagacggagtctccctctgtcacccaggctggagtgcagtggcgccatctcggctcactgcaagctctgcctcgcaggttcatgccattctcctgcctcagcctcccgagtagctgggactacaggcacctgccaccatgcgtggctaatttttttgtatttttagtagagacagggtttcaccgtgttagccaggatggtcttgatctcctgacctcgtgatctgcccgcctcggcctcccaaagtgctgggattacaggtgtgagccactgcgcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaaatactattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaacacagggagatccagcttcttaaaaaaaaaaaaaaaaaaaaaaaaaaaattttccggacacggtggcatcctcctgtggtcccagctacttgggaggctaagatgggagaattgcctgagtttgggaggtcgaggctgccgtgagttgtggttgcaccactgcactccagcctgggtgacagagcaagatgctgcgtcaacaaatcaaacaaaatcattttgttaaagctagtacttacttacgtatgtggtggaagggttttggggtcagatagaggcacccagcctttctggagttctggcaatgctccatcccttggtggtagttggactggtatttatgtaataacttcatgaaacggtatacatatgttttctatgcttttctataagtaagtaatacctcatagtaaaagcagttttaaaataatcagattttatagtgcatgttccattaaaaaaatgtggaaaatccccaaagcacatgcatatacagtagttaatcatgttttatcttaaatttattcatattatagaaatttaccttttgaaatttcatttttatttatttgagatggagtctcgctctgtcgcccagactggagtgcagtggtgtgcatgatctcagctcactgcagcctccgcctcctgggttcaaactattctcctgccttagcctcccaagtagctgggattacaggtgtgtgccaccacgcccagctaattcttgtatttttggtagagatggcgttttaccatattggcccggctggtctcgaactcctgacctcaggcaatccaccctcctcgacctcccaaagtgctgggattacaacatgagccactgcgcctggccttgaaatttcatttttaaaagctctaaaaattttccaggtgagaattgaccaactattattattttctgggtaagggactccactacagtaattaaagaaggataaggttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttttttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatggagtattgcattttttgatacaagaactatttgctccttaacatctttctctaggagtttgaaagaaaagaaattactctgtgtttcagtctctaacttgtgattgagtggctgaggtgggaggatctcttgagcccaagagttcgataccagcctgggcaacacagtgaaactctgtctaaaaaaataaaataattaactgggggtggtggtgtgtgcctgtagtcccagctacatgggaggctgaggcaggcggatcacttgagcccaggagttccaggctgcagtgagctaggatcatgccactgctgcccaggctggccatagaccaagaccctgtccctttaaaacataataataatctttcatatgttagaatgttaaaaataagtataagaagtttgaaatgtttgcatccaaagtgagatttaatacatagctatttttgataaattgaaaagtgtcaagaaaactgctgtttaaatttcatttataatcatgatctcataatagtaccattcaattttctccaatagtctctggtatttttagtttgtttgaagcagcgtccaaataattgcagttaactgataggtctgttaagtctcttaatcaatagaatacttttccccatcccttttttccttgcattttatttgttggaaaatccaggctgattgttcagtagtcagaagttccctcattctggcctttgctgtttccactggacatgttcttctgcctgtgggtggatatagaggctcgatcgctttctggctcagcctttcagcacaggtacttcagaggtgcgtgatgccctcaccaggaggcacacatctgcactgatgtgagatccagtgttgttgttgttgttttttccttttgtcttttttatttaaaaatcatggggtcttgctatgttgcccaggctggttttgaactcctggcctcaagcagtcctcccacctccgcctcccaaagtatgctgcaagcttaagccatggcgcctggcagatctagtgttttttgaaatctcatgttttattctaacaattgatcgaaacattataatctgcttctcaatatggccatgttttatgcttttcacgtcttcaaatacagttgacactccaggaagatgaaccttatcacatttgcaacttctgccccttatacagccccggggctccagccccatgtggcaggcgtgacctaggggaagcctccatctggagaagtgctgcctgcacttggttgcatatcgagtggactgagcccttggctcctctcgctgcttcctgtccagatggcaggactctggtcgtgggccaaaagaggcacagtgtctttgcatataataaggattgaatgaatactttttaaaaatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggccttcctgagtagctgactacaaactaaacttttatgaaagaattttcttaaataattagagatgcctttcatttagctaaaaacaagacctcaaaatacagtaaattcatgtctaagactgtagcaaacagtaagtaaagtaatagagtaaaaattctgcttaaagaagactgcagaataagaattgcaggccgagcgtgctggctcacacctgtaatcccagcactttgggaggccgagatgggtgaatcacttgaggtcaggagttcaataccagcctggccaacatggtgaaaccctgtctctactaaaaatacaaatagttgggcatggtggcacacacctgtaatcccagctactcaggaggctgaggcaggagaatcgtttgaacctgggaggcgtaggattgaaccaagattgcgccactgcactccagcctgggcgatagagtgagactccgtctaaaaaaaaaaaaaaaaaaaaaaaagttacagcgctcagagtgccagatgctgcgctcctggtagtttctggtcttggcccttccttagctcaaagtgcactggcataggtgccattttttagtcacacaattcccttcattgtaattttcttagcactgtctttgcttagtggatctgttgttgccattcagcagtacatttctctctgtgtggaagcaaacatcttctcaaacctgatgctcagtgaggataggcagtgggctattaaataggcagtggcctcagattcccagcatgtgtatgattgccgtgctaaccagaggcgcatgtgtccagcatctgggcattggaacctgcaagctgctcccccaaatcaggatgccaaacattaattggcaagttactaaaagttgcctcaaataccatctttaatgcatttaactgaatttgcataatttttctttatcagcacaataattattataaatattgtagaattgccattaacttataattgtcatatctaaattttaggataaaaatagaacttaactatttttatacccatatataagcaagtgaagtaaaggtatttatgtttaaatcaagaaatctaatcaaaggtttttacaatccttccaaatatgcaatctcacttatttcttgccacttctggtgataggtctgtgtgtggaagacacgggattcctgcctgtccacagctcagtgtgaacggaccagatatggtcacagattagaatttaccatcacagggccgggcgcagtggctcaggcctgtaatcccagcactttgggaggccgaggtgggcggatcacgaggtcaggagattgagaccatcctggccaagatggtgaaagcccgtctctactaaaaatacagaaaattagccaggcctggtggcgggcacctgtagtcccagctactcaggaggctgaggcaggagaatggtgtgaaccctggaggcggagcttgcagtgagccgagatggcgccactgcactccagcctgggcgacagagcaagactctgcctcaaaaaaaaagaaattatcatcacaggcctcgtgggtggttcgtgtaagaggctgaggcaggaggattgcttgagcccaggagttcgagaccagtctgggccacattggcgagacctacctgggcaacatggcgagaccctgtctctacaaaaaatagaaaagttagcggggtgtggtggtgcatgcctgtagtcccagctggttgggaggctgaggcaggaggatcgcttcagcctgggagttcaaggctgccgtgagccatgtttgcaccactgcactccagcctgggtgacggcaagaaaagaaagaaaataaaagaaataacctcaaaagaaaaaaaagaaaagaaattacctcaaaagaaaataaattacccttacagacattttatttttattttattttttttacagacaaggtctctctcttgctcaggctagactcaacctcctgggctcaagtgatcctcctgcctcagccttctgagcaggcactacaggcacacgctgccatgcccgacaaccaccacagataatttagaaaaaattagccttttagttttaggagctttcttttacagtgatatttagtttggggcctttgaacttggtctttgcttttggagctgtacttgtaggtgttgttgttccagcctgggaacgagacatgaccgactccagtgcggcctgcttgctgtcctcaccatcagtcagtgtggtccgtgtgtgaggctgcagttgtcctcttggccacttatttctccttaattctctgcatgtaatttaaaacattatcccctgaaacttagtttttcattgacttctaatatctttacttctccttttaattttcctattgagatacttaggatgacatgaaattctttggatctacatatggacaaacagaattgtgtcacataaggttcagtgtgctagctgtttaaaaaaaattaaaaacagtttgttttttttagagacagaatcttgccctgtcacccaggctggagtgcagtggcgtgatcgtagttcactgtaaccttgagctcctgggcttaagcagttctcccgcctcagcctcttgagtagctaggactcacaggcatgtgtcaccatgccaggctaatttttattttatttttatattttatttttattattatttttttgagacagagtctcactctgtcgcccaggctggagtgcagcggcacaatctcggcttactgcaacctccacctcctgggttcaaacgattctcatattctcctgcctcagcctcctgagtagctgggactgcaggctcacaccaccacgtccggctaatttttgtatttttagtagagacagggttttgccatgttggccaggctggtcttgaactcctgacctcagacgatcctcctgccttgcctcctaaagtgctgggattacaggtgtgagccattgcacctggcctttatttttttttagaggctgactgagttttgctgtgttgccaaggctgatctcaaactcctggtacttcaagcagtcctcttgccttgacctcccaaagtgctgggattacaggtgtgagctaccacgtcctgcctgctagccatttttttatgttcgtggtggtggtaaggagtggctaccaggctgtgcgggattcaggaatctggatgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataacttacataatgttttcagggtccatccatgttgtagcatatatagtacctcatttttttttatgcctaagtaagagttcattgtatgaatagaccacattttgtttatccatttaccagttgaccatttgagctgtttctactttttttttcgctattgtgaatagtgctgctgtgaacgtttgtgaacaagtttttgcgtgaacagactggttctcttggtatatacatagagatggaattgttgggtcatacggtaattctgtgtttaacttttggaggaactgccagattgtttccacaagggctgcaccattttacattcctgtcaacaatatgtgaagattcccatttctccatatccttgctaacacttgtgattttctgtttttaaaattttagccatccaagtgactaagtggttatagtaggttttggttttggttttgagacagagtcttacttttgtgttgcccaggctgcagtgcagtagtgcaaacatggctcactgcagcctcacctcctgggctcaagtgattcccacctcagccccccagatagctgggactacaggtgtgcaccaccacacccagctattttttgtatttttttgtagagatggggttttttactgtgttgcccaggcatgtcttgaactactggcttcaagtgatctgcccacctcagcctttcaaagtgctgggattataggtgtcagctgccgcacctggctgtttttttttttttttttttaacaatgttttaaaataaattgtggtgagatacacataacattagccatttaaaagtgaatgattcagtggcattttgtacattcacagtgttctgcaccatgatctctatctggttccaacacatttttttcgttcccaaaaggaaaccccatacccataagcagtgagtccccattatgcctcctttcaaccactggtaactaccagtctgctttctgtcttgtggatttccctattctgtatgtttcatgtagatgaaatcgtagtgtgtgccctttgcttctgacttactcacttagcatgttttcagggttcatccatgttgtagcatgaatcagaacttgattcctttttaaggctgaatggtattcactgtctggatagattacattttgtttattcatgtattgatggacattttggtggtttctacctttttggttgttgtgaagagtactgctgtgaacatgtgtatacatgtgtttctttgagtaccttttttcagttattttgagcatgtacctaagagtggaattgctgggtcatatggtaaaatgttttaactttttgaggaactgccagcctcttttccttagtggctgaaccattttgcgtttccacagcagtatatgagggtttcagtttttccacatcctaacacttgttattttccttttttaaaaaaattataggccaggcgcagtggctcacacctgtaatcccagcactttgggaggccgaggcaggcagatcacctgagctcaggagtttgagaccaccctgggcaacatggtgaaaccccatctctactaaaatacaaaaaattagccaggcgtggtggcaccagcctgtagtcccagctactagggagcctgaggcacgagaatcacttgagcctgagggatggaggttgcagtgagccaagatcatgccaccgcactccagcttgggctacagaatgagactttatctaaaaaaaaaaaaaaaggccaggtacgttggctcatgcctgtaattccaacattttgggaggccagggtgggaggatcacttgagcccaggagtttgagaacaacctgggcaatataatgacaccccgtctctacagacaataaaataactagctgggcatggttgtgtatgcctgtattcccaggtattcgggaggctgagttgggaggattgcctgagcccaggagttcaaggctgcagcaagtcacgttcacaccactgcactccatccagcctgggcaacagagtaaaaccctgtctcacaaaaaaaaaaaaaaaaaaaaaaaattacagccatcccagtgggtgtgaagtgggaactcactgtggttttgatttgtattttcttttttaagtgaaagcaagtttattaagaaagcaaaggaataaagaatggctattccataggcagagcccattgccactcagctgcttatacttattgttacttcttgattgtatgctaaacaaggggtggattattcatgagttttatgggaaaggggtgggcagtatctggaactgagggtttctcccctttgtagaccatacagggcaacttcctgacgttgccatggtatctggaaactgtcatggtgctggtggaagtgtcttttagcatgctgatgcattataattagagtataatgaatagtaaggacaaccagaggtcactttcatcgccatcttggttttggtcagcttctttactgcagcctgtttcatcattaaggtctttattacctgtatcttgtgccgacctcctgtctcatcctgtgacttagaatgcctaacctcctgggaatgtagcccagtgggtctcagccttattttactcaccccctattcaagatggagtttctctggttcagacacccctgacatgtttcccccctcccttttacagcagaacccttaatcctaacagtcgtagagggacaaagatccatcttctgtaacttcttcaggctgaatggggcgatgatattcctgcctaactatgagggtctcttgtattcagggtagagaagagctcagtcagaaagcatcaatatggtgagggccattcatagctctgagttccaacaaaaggtggtatctggaagattaataagtgttcagtttaagaaaacattcagtaaacttatcctgcattcctacacaaagagtacaacagcaatatattccacaacagtaaagtagaataactaaaattatcctgagtaaactaaacaagaaggctttccatgaactgggcagttgttgaaaccaaactgatacatcgggttgctagccgactccagtatgtgcccagaattagaatattgatccagatttttacattacccatctctcttgtttcttgtgagcagcagccagagatcactgattggttcacaggagtaagcagggttagcctaagttgcagaaaaaaaacttaaaaacaactgatgagactagaatctagtaacaggtgtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcctctcctcttgaggtcccaagatggcgtggggttcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcacaaatagtttccaaattccagagaaagcaggtagagaaaaacaaatatgctccaaattttgttcacaggagtatactttactcaattgtcaaaagctgtaagtagctcaaaagttttcttggctctgaaaaacaaaaatgatcagcaacgttttaagcaaaaagtcagaaaagattacttgagtcttttgttcagtccatgcagttaactcctgttctacttgatattcataatcatttcagctctccatgagagtcctgaaagaacctctgttcttcttttttttttttttcttgagacagtctcactctgtcgcccaggctggcatgcaatggcgtgatcttggctcactgcaacctctgcctcctaggtttaagcgattctcctgcctcagcctcctgagtagctgggcttacaggtacgcaccaccacgcccagctaatttttgtatttcttagtagagacggggtttcaccacattggtcatgctggtctcgaactcccaacctcaggtgatccacccacctcggcctcccaaagtgctgggattacaggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgactaggaattttgattacttttgtggcatacgattttacataataattgtaattattagtaacatatgctaagtcatatcacaattctaggagtttcccattactttggaacacataccaataacatatttatataaatacaggtcaaagaaagccaaacaccatttcatatttgacagtgcttcctgtatgatttttataccaaataagccaaatttcaccattgcattagtgtactattaatgttaaacccaattcttaataaaacattatagacaaatctacccaattttaatgtcagaccagaaggtaagattcttataaaccttttataaccctttacaaatttttgttaaagagcagatcagtgctctaagaaaaccttgttacgcttttattccagtgttcaatttacggaactgtatcatacccctttaacttcagccagtatgttcacacacagaatttcttttaaaagattaatttttcacaaaatttccacaacttttgcaaaccttcagctttatcctaacttaaaacaatcccttaaccctttaatttaggccaaaaaaaaaaaaaatccacattcacatgtctccttctcttttaccaaaaacacatttcactttccctacacaccttgcatgtaaaactgtttttccagtagtctcaagtagatgttacactgttaactcttagcagtgtttatttttagtgaaaaacttggtaagcaattttaattatgtactaggtatggagcctaggacaccaggcagaagtgcagataaggtctgacacttactagcatagctaggaggcatggctaactccacatgtccctaggccttacctagaatctaatggctgtaggtaagtttaacaattttcaaaagtcaaagaggcagtttataaagttaaagcgtttagcaaacctaaaatttgacctgcctgatttagaccgaatgtctttattttaccaataatctttaaaattttctttacttcccacagcttaagtcacacgaattaaaaggcattacgctttttatttttctgacaaaatatttgatttaaacacttatttttaagccaattaatcaaagccttttatatcacacacacaacacatataaatacacagacagaagaaaatgtagtagttgtaaggtttttcctttgccagtttcttaattggattagtggctttatggtggagccctggaggaacagggcaaggaaagcatgcagtttctatggcctaataagcaggcacaattggaaggcaagacagagccccaaaacttgagggtcccatttttatattgatcctggatcccccaaagagaaacgctacagaacacaacagtgcaatgattttaccacatatttcattgccaggcaacccagagccaatcagccctttctgagatcagcccatcccccatgggagtcttatctctcagtggggaagggtgaggacatctccataccttccaggtggccaagagcatgctcttaatccagacacacaaagatccaagtatcccccacagtgccatttagccatccccaaaagtattaaatgtatttcctacctagttatattacacaccaaagttctctcataatgtgaagtaatttctgatacccccaaagtaaaaaacagataatgcagtgcaaaacagaacagagccatagattttgagagggatctatccacttttaataattctcggggttccatgaggaaaatagaggtttttcccaaaacagggtatgtggtgcctcctctgtttttcctaagaagtcccaggctgttagagcttgaatatcgacttttaattaagctgacttttaaccatagcactctttaaaaagtcgttttaaatatcttattacccaactttagccacgccaaactgccaatattcctggctttttaacttttccaaatgtaacctcccaggtgctgagagaaaggaaaatttaagacagtttatgaaagggaggagaatcaacaaatggcacaggtcacccaaatgccaaccagaaagtgctcattttctaggctaaaaattgaacctgaactcaggccaccattgtgaaaagacaaagccttaactgctaagctacagcattgggcagtttccactgcttttcccagaaggagcccagagcagtaaattttgagcttgcaaaggcttttaactgctcaagataatttgtagagctaactactaccccaaaatccctgttgcctggaaggcagagacaaagagaaagtactgccatatgattacaaggtcaagctctcagggacatttctcaacatgtggtctttgggcaagatggtggccctgaataacagaaaagataggaaagggaaaggaaagaaagggagaaaagcattgcctgcagcaggctggggaatgcaagaagctcagggaggccagagaaagacccgcccattgcagctgacactgaatcagaagttcaggtggctgctttttgggagcgtagggatctttcccagcattcccatcagctctagtttccccttttggggaggaaaaagctccccatgtcccataatcttggacatgtctagttctgtcacccacagccatcagcaaagagtgcaaggcagattaatccaaagagaatagcagttaacatcccatagtgccaaactggttcttagtcgagagggactctactgagaggggcctccaaccccctaaattttaggaaggactctaaccttcctaagttgggcatcaaacccaagttcagtcaagcgtgcttgccttttattaacaggcacctttatccctctcttaggagagactctaactctcctaagttgggcctctaacccaatcccatcctttacccaggtaactgcatcccacttacccaaggtcggccaatcagtgctgcagtctatttcctttgggttgggagtctcctcagtatcatccctttggggcttgccaggaagatgttaccggaaaggggtcccaatccagaccccaagagagggttattgaatctcatgcaagaaagaattcagggtgagtctataaagtgaaagcaagtttattatagaagtaaataaaaaagtggctactcaataggcagagcagccgatttgtattttcttaatgatattgatattggacatctttttatgcgcttgttgaatatttcagtatcttccttggagaaacgtttatacagatcctttgctcattttaaaattgggttgtctttttgtggttgagttataagagtgctttatatatatcctggatgctaaacccttattagatatgtgatttgcaagtatttcctcccattctgttaattgtcttttcactttattgataatctcatttggtgctcaaaagtttttcattttgatgaatgaagttcagtttatctagttttttattttgttgcttatacttttgttgttgtatctaagaatccattgccaaattcagggtcattaaagatttacctcctgtgttttcttctaagagctttctaatatattttttggggatctcattcatttttgaaagatagttttactggatatagaattcttggttgaaaaatagccagacatgatggcactggcctgtagtcccagctcccagagagactgaggcaggaggattgcttgatcccaggagttggagactgccgtgagctatgattgcaccacactgcactccagcctgggtgacagagtaagatcccttctccaaaaaaaaaaaaaaaaaaaattattggttgacagatttttttctttcagccctttaatttgtcacctttcggcctccatggctttagatgagaaatcagttgttaatcttactgagaaatccttgtacttgaagagtcacttctctcttgctgctttctacagtttggctacagtgtgtctgggtgtggctctttgaatttatcctacttggagtttgtcgagcttcctggttatgcagattaatgtttctcattaaatacaggacttttctaccattatttcttcaaacttttttttgtctttttttctctctgtctttctaagaccctataatatgtatgttggtacaattgatggtgtcccacaagtctctgaggctgtttattttcttcattattttttcttctgttccttacactttataatctcaattatcctatctttaagttctctgattcttactgctgtttatttctgctgttgagcccctgcagtgaatttttcatttcagtttttgtgcttttcaactccagaatttttgtttggttctttttttaaactatttttttctttatcaatattttctattcagtgagacattgttctgatggatcttgtagatttttgaacatggttttctttagttctttgaacatatttaaaatagcatatttaaagtcttcatccatacgtctaatgcctgggcttcctcttaaacaatttctgttagttgccttttttctgcatgtgaaccatactttcttgtttctttgcatgccttgtgatattttgttgaaaactggaacttttgaatttttaccgtggcaactctggaaatgagattcttccttctcccccagggtttattgactgcttgttacagtcattgtttgtatagttacttttctgagctaattttatatagtatatattctttatcatgtgtggcctctgagttctctgttccattaatatagtggtcagcttgtgattagacagagatttaagcgcctagaacaaaaaatgtctcccagtcttttgagatgaggtctgtgtgtatgttggagcacaccttcaacactcagccaggcatttgacggtgatccctgagcattcgctgcctgcttgcacagatcctgaaggtcagccagaggtgaaagcctagggccttttcaggtctttcctgaacatgtacacagccctgggcatttgtggagccttctggatttccaagaatgtgtcagagcttttcaaacctttattttccaaaacatcttactcctcagcttttcttcccaagcttttggttaaatctattgtttgcctcaactgttattcagtgcttcaggcagcagcaaatatgtttgtctgtaaatgtttccaataaccttttcccatctttccctagtagatgcctcagcactgggaggtaaagtcaagccctttgagccagtcttccagggactcagtagacaggtcgaaacaaacaactgcagttctttgccgatgaggcccattctgctccctctgggaccagtgcatgcaccggagtggcagcctcttgtcttctaggccactgcggcagccaggatgggaccagagaaagttaaaatgccatggaactcgcggttcttgctgagattcacctggtttttcttgattaagcattcttctgattgctgcaagtttttaattagttttccaaagttttaaaatagtagattctaacggtttttgcctttttcttttttttttttttttttggagacggattcttgcgctctcacccgggctggagtgcagtggcgccatcacggctcactgcaagctccgcctcccaggttcacgccattctcctgcctcagcctctctagtagctgggactacaggcacccgccaccacgcccggctaattttttgtatttttagtagagatggggtttcaccgtgttagccgggatggtctcgatctcctgacctcgtgatctgcccacctcggcctcccaaagtgctgggattacaggtgtgagccaccgcgcccggcctagtttttgccagtttttaaaatgtgtatattgaaggatggactttgagttccttactcagccatttttgtggacatgatttactagtcataatttaaattgaatattttaggacatattaaattatgatcagtttcgaggttgccaaatttacgtacaccttacttggttacacaagagatttaagatggcttacaaggataaatagcataagagatgcaataaattatcattgtcagtatttgttgggttgagggcatgttagtaaaaactgccctccctgctgttaagaacttgatcctacagacagaaatgtttccttggcagccttgagattcttgccctctctctgttacgtcagtggtggggaacctggggcagattcgcctccgtggcttctcctgcatgactgcgttgggctgagggagatatgccaggttagtgcccagcagtagggatggttgttactgtctgcctctgagttgattgtgagaaatgtgtctccagtgttggttttcctaaatctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatagaaggtcacggggctgccggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagagagacagcttctcatacttcggttactttggcacagttttgcattgtgtgtttctgtgggggtgagtgtgtgaatgtgggtgagtgtgtgggggtaagtgtgtgtgggggtgagtgtgaatgtgggtgagtgtgtgggggtgtgtgaatgtgggtgtgtgtgtatgggtgagtgggtgaattaaagaggaaagcagagatgttgggggtggaggacacacttagaaaacaatgcatttgttgaacaaacacctattgggtacctactgtgcgccgggcagtattccaggagctggggactcagtggtgaggctcctctagtgggaaaaaatactaacaaatgtgtaacatcgggtagtgatcagttccatgaataaaaatcaggtggcatcaagggaagagaggtgatcagcactggcttgtctgaggcagccaagggacagtgggggagcatgtggaccctaagctggaactggcagggctgtggggttcaggagctgtgtggaacacaggtcagatgtgagggcagtggggcagccagagggtgaggggaaaggcactgggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggaggacagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttgtattttttgtagagacagggtcttgccatgttgcccagtctggtctcaaaactcctgggcttaagccatctgcccacctcagcctcccaaagtggtgggattataggcgtgagccatcgcacccagccgtggagctctaatgaccaaaatttagggagagtttcttttgcttttttctctatgaaatgagttgtagtcctcttaggttggtgcaaaagtaattgcgttttttgccattaaaagtaatggcaaaaacggcaattacttttgcaccaactaaatactttataatctctgaatttgccttgctttctgtaattttcctgtgtccatgtctttcttccattgtgaaatctttttcttgtgtggtacttcagatgtttccagttattaagaactcttgaggctgggtgtggtagctcacacctgtgtgcccagcactttgggaggctgaaacaggaggatcacttgagctttggaattggagaccagcatgggcaacatagcaagactctgcctctacgaaaaataaaaatttagccgggtgtgctgaagcatacctgtagttctagctactagggaggccaaggtaggaagattacttgagccagggagtttgagactggtagtgagccataattgcaccactgcactcagcctgggtgacagagtgagaccctgtctcaaaaaaaagaacttttaagaactgtgccctcccctttggaaaatagcagtagtgtttttttggagtcaagtaattcctccaggctgtgcataatggctcatgcctataatcccagaactctggaaggccaaagcaggaggattgcttgaggccaggagttcaaaaccagcctgggcaacaaagtgagaccccatctctagaacgaaaataataatttctccagttgttaaatttcagtgaatgagacacatgcctaattaacaagacttcaggctttacatatgttaatatgttgccatctcatgccagtcagaatggcgattattaaaaagtcaaaaaacaacagatgctggcaaggttgcagagaaaaaggaatgcttttacactgttggtgggagtgtaaattagttcaaccattgtggaagacagtgtgacgattcctcaaagatctagaggcagaaataacatttgaccaagcagtcctattactgggtatatacccaaaggaatataaatcattctattataaggatacatgcacatgtatgttcattgaagcagtattgacaatagcaaagacatggaatcaacctaaatgcccatcagtgatagactggataaagaaaatgtggtacatctataccatggaatactgtgtatccataaaaaggaaggagattggctgggcgccgtggcttacgcctataatcgcagcactttgggaggccgaggtgggcagatcacctgaggttggaagttcgagaccagcctgacgaaaatggagaaaccccatctctattaaaaaaacaaaatgagccgggtgtggtggcaggtgcctgtaatcgcaggtgcctgtaatcccagctacctgggaggctgaggcaggagaatcgcttgaactcaggaggcgtaggttgcagtgacccaagatcatgcactccagcctggtcaacaagagcgaaactccgtctcaaaaaaaaagatctgccggtcacggtgactcacacctctaatcccagcacttttgggaggccaaagcgggtggatcacctgaggtcaggagttcaagaccagcctggccaacatggtaaaaccccatctctacttaaaatacaaaaattagctgggcatggtaacacatgcctgtaatcccagctactcgggagactgagacaggagaatcacttggacccgggaagtggaggttgcagtgagccaagattgtgccactgcacttcagcctgggcgacagagcaagactccgtctcaacaacaaaaacaaaaaaaaaaaaaaagaaaaaaaggaaggagatcatctactttgcagggacgtggatggagctggaagtcattgtccttagcaaactaacacaggaacagaaaaacaccacatgttctcacttataagagagagctgaacaatgagaacacatagacacatttaggggatcaacacacgcaggggcctgtggggttaggagagggagagcatcaggaagaatagctaatggatgcggggcttaataatacctaggtggtgggttgatctgtgcagcaaaccaccatggcacacatttacctgtgtaacaaacccacgcatcttgcacatgtaccctggaacttaaaataaataaatatatagctatcaaagttatattttgcttcttgccaaaatcagttacctttatttgcagaatagaatccaacaactgatttttgtttaagaaggaatcgtagcgtatgtctgttaaacaccatataagtaactgactctgaacaccagatgaggctgtaacaggtcaggtttaagcacaagcatatagattcacgaaatggcgtcagaccctgccctggttgcttaggatgcacaggagaataaattgcactctctccttcagtttgcagtctgatgagagagacagccagatgtacagtttaattcatgttagtatgggaagtactgggactgtaatattaataacatgccaacaaggaaggaccagttacaatagcttagccggagtgtcaaggaaggctttagtgaggaggttgcctttcatttgatctgggccttgaatttgtcaactaaagacaagggagaaagagaatagatggaaagcacagaatgataatgagtttggggcctgatttgtgcaaacattccttataaattgcacttcatgcttgagatgaaacaagttgaaaaccgtttgagcagtgttgacagtagagtgcattttaaggtgtgtgtcagcttctctcagggcctgcagacatttcagcaagcacgcgtgtttggggtcctgccagtgcatctgcccctgcctctcagcctgaccaggggagagcagttgctggttggctgcctttgctccaggcctggttctgtgacttgcccttgccctaggccacctctcttttcagtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttctgtggtgtgtcacaacatcaagtgttgataaaatgtgctgaggatgcatggaaaccctggaccattgcagttcatataaggatttcttttctacgtttaaactgtggtgtagacagtatgccagctattttcaggttttattattactttttaaatttataggttagcataatttaaagtgtcaggaaacaaaccttttagatttaatctagaaattctggaccatcattctttaaacagctctgttaacttgtgaaggtcaggatgataaagatctcaccctatgggaaagcatacgtggtacaagtctgtaggtatgaccgctttggaaatcaactgtcagtatcctactaggttggacattcaggcactcagttaaccagcagttcttctcctggatgtgtaggagaaacacacacgccaggaaatgtggccaggtgtgaccagagccgcagaaatctggaaacagccggagcacccatcagcaggtggaaattatattacagtgttgttatacgacaaggagatgtgtcatacagtagtgaaagttagaggcctgcagttatttgcaataggcagatgagtctaagaagtgtaatactgagcgaagtccagaagactcctatggtagaattctgtattaacaaaattcaaaaacaatcagaatgaaacagtgtttcatttggcacacatatgtatagtgaaacctttttagaggcagaattacaaaactcagggttgtggttttaatgggtactccttgtgggagaatgagggtgagatgggagaggtaggtgcagaagatggatgttatcagtcatgctcttggacctgggtgttggcttcatgggtgttcactatgtagttatgctttttttttctttctttcttttttttcgaggcagtgtctcactctgccgcccaggctggagtgcaatggcacgatcttggctcactgtaaccttcgcctcccaggttcaagcaattttcctgcctcagcctcacgagtagctgggattacgggtgcccgccaccgcacctggctgatttttatattttcagtagcgacggggtttcaccatgttggccaggctggtttcaaactcctgcccccaggtaatccgcctgtctcggcctcccaaagtgctgggcttccgcacccggcctgtgcttttcaactcacacatgtgtgcacatatatgtttgtgtgatcagaattacatttaatttcatagataggactgatttcattaatagacaaatgaaaaaaaatcagcagcagattcagggttttttaaaaaatgaatgtgttattttcctttggcttctgtaacaaagtaacccaaagttggtggcttgcaaaaaacaaatttatcctgtcatagttctgggtctggaaatgcaaaaccaaggccctgctgtctcttgacaactgtagggaaggcttccctgcccctctcagtttctggagccaccagcagtccttggccttccttggctcatggctgcaccactccaacctctgccctccatgttcacgtggccgtcttcctagtgcatgtcctcacctcttctaagggtggcagtctttagatttagggtctgcccgacgccagggtgtcttcgtcttaactgacgccatcttcagaaatcttatttccaaataaggtcacattctgaggttccagatagacatgaattttggaggacattattgaactcactgtagtagtcaaaagctgtgaaaatgccttttcacaggaaaagaaatagaaatgattaatagagaaatagaaatgattaatatcaaaaatatgcttaagactgggtgcagtggctcacacctgtaatcccagcactttgggaggccgaggcaggtggatcatttgaggtcaggagttcgagaccagcctggccaacatggtgaaacccctcctctactaaaaatacaaaaaattagctgggcacggtgatgtgttgcctgtagtcccagctcctccggaggctgaggcaggagaattgcttgaacccaggaggcggaggttgctgtgagccaagattgcaccactgcacttcaacttgggcgacagagtgagactccgtctcaaaaaaaaaaaaagaaaaagcacatatatatgtgcttaaccacacattactaaagaattgcaggtcccactcaccccatttttttacctatcagattgccaaagattgtgcgatagaattggtgaggatgtggaaacgtgcatcccctgatactgggagtggagactggtgtgggcttgttgaaagtcgaacacagaaagttactgagtggccttctcttccctggccacagtgctgccctccactcccttctttctcagcctccctgccctgagccccatccctattctgccgcaaaaccactgtgggtgcctgcagagttgggccttagaaacatgccgaggaaagcaagctcctgggggagaggagcaaccacgttccgaggacgagcttccctcgggtgggccgctgccctcctcagccctcagacccgccagtcagactctggctctcagcaaatccctccccagttccttcagcagaacagcaacataactggaggccaaaagaggacctgaaaagatggatgggggaggattgaggcatcctgtggccactgggaaaccgctgccacagtcttctgctcagcagggactgttcagcgtggctccatctctggctcttcctcatcagtctctccccaggggccctgcagttgatgtccttgtggggagtccttgcccttgctctgctcatggacaggcacccagcaggtgcccatgggatagggcttaatagtcgccatcatccagccttagcaaaggtgaagtttgtgctattagggaaggcctaacccaaaacctatcccaattttctatggactaaagataatgtagattaaggttctaggttagtaatgtaaatactcagtaggttatgctgctctgacatacttgggaagcatcatttccagactccaaactaagaggccaagggaaaccctccgtctctcaaccagcagaggcagacaccagctgggtccccagctccactgtccacctgtgctgtgagtgctgtgtgagtggccatgcctgcctgagcattgcacgataggggctgtgtgaaccaggagcagctctggcacagaggaggcgtgctaaggggaaacccttgtggcgaggcccccaccagcagactgttctgaggcaagccgccctcactggtcagatctgaccagatctttggagatacctgtggcatcctgagacactcacactccgtgacaataatgactcagccatacgtaatgtgagtgccataacttagaggacagcgatggtgagcagagccattcctgggggccccatggggatctcagcgggactgaaggaagacaggttgtgtgtttaaagttgatagtactttctctctctgtagaaacacgaagacaccgactgtccctgcgtggtggtgtcctgccctcacaagtgcagcgtccagactctcctgaggagcgaggtaggggcggccgggcccggccgggagtctgtggagtcctcagggctgcgtgcctggctccccttccctgcatagccgaagcctcacgttttcccagttcgtgagagtcatgtgtatggcagacaaacaaaaaccacagcaaaaagccttatgccattttttggaagtcagaagcaagcattagggttaaaagctacagtgtatggccgggcacagtggctcacacctgtaatcccagcacttttggaggcctaggcagatggatcacctgaggtcaggagttcagaaccagactggccaatgtgctgaaaccccgtctctactaaaagtacaaaaactagccaggtgtggtggcgcgcacctgtaatcccagctattcaggaggccgaggcaggagaatcatttgaaccggggaggcggaggttgaacagagccgagatcacaccactgcactccagcctgggcaacaagagttaaactccgtctcaaaaacaaaacaaaacaaaactacactgtggtaaattcagagcaaagattgtgaagcattaagaaaatgggaatattttacatacagtacaagcaaaggtgacgaggggtttttaaagcaattttaactctatagaatagtaattgctgtaagattatctcaagaacatgaattaacttagagacacttcagaaccattttgctcacacatgccgggtggaggacagctcccacattttagggctgccagaagggcccctgtgtggcctctcccaaaggttgcacgtctcacattgcgcttggcactctttctttgagacaggtagattttgcattgacttcacttgatcaggatatgtccagttgggaaaatttcaaggattcttaatgtttctgcatctgtcctgacggggagctcctttagttagtattctgggagtcatctggggctaccctgggctccctggatgtgtggtacgctgatctaaggagccggctcaccttttcacctcagcatttttcaacagcctgaaattttaccactggatactgggtaacagggagaaccagcctcgcatgcccctgactgagcaagagggcccatgtggggctagggccagggactcagggtagaggagggcccagagagccactctcccccagggtgtgccctcccagcaccttgaagctgatgggtgagggcaaagtcttgcctgatgacagtggcctctgggccctgaatctgcccctgggaggagctagggaaaaataaatgtaaattattgccacaactggacaatcctctgttaatgtataaagagtctgtgctgttgaaataatttctttttttttttttgagacggagtctcgctctgtcactcaggctggagtgcagtggcgtgatctcggctcagtgcatgctctgcctcctgggttcacaccattctcctgcctcagcctcccgagtagctgggactacaggcgcctgccaccacgcccggctaatttcttgtattttttagtagagacggggtttcaccttgttagccagcatggtctccgtctcctgacctcgtgatttgcccgcctcggcctcctaaggtgctaggattacaggtgtgagccaccgcgcccggccaataatttcttatttaaaacattgttaaacctgcatttctgttgggtttctgatgaaaggtgcttttgagctatagattattcttgcccctattccagagatcctgtagattccccgagactcagaatactgataataaaaccaatttagaaaaagacccaacaccgaatttactctagtacactgaaaataacatacatcaaacccagtgtgtcagtgtgtccctggcttaacatgtaatagcgttgacactcaggtttgttattgcagtaatgacactggaagaatacattccaagtttttaaatgaacctggttctgcgcagtcttcacactgcgtttccttgccagtcacctgtcacgtgccttgtgggcgcttcctgcaggggcagccggtctgggttctgaggagcagcaagggcgtcaggctgccaggttcctaccaccttgactctgccctggctctgagaccttccttgaaggttgaccctagcagtggccgcatgggcccctcagtcccttcccgcagtgtccctcctccttagtttcgcagcagggatccattttcccctctgttgtaaatatccacctagagggaaggaccgcctttgtcctggtagactgagaagttgtagaacttagctgcgccctccaggaggatgtgctctatgagccttgggaacacatgcatgctggcacacagaagaacacattcccggctgctgcacccacacacccatcctcccaaaaagagtctgttttctgtgaagaagatctatccctagagtttcctgatgggaatttcttcaataaaagacaaaacttctgctcagtcttggggcatgataaagaaaaagaccaaactatacctcatttgtattagcctaacacatgactctaagtccttaaaatgtaatcctttccattcccttttctcttgttagggcatcataagtaatttttatttgataactcaccagcatttgagctgagcaagggacttttttcttgcaaaacgagttacctgctcccagccccacctaattttcctgccatcaattagagttgacagtagtaagagtgtatggttagactgatcttagaggtctttgaaaagctacctgagtttctggcccttacagagggaaaaagtcttttcagatgaaggaaaaactcatctgcacttatctcaagtattatgagtaatggtacattgtgtaagcttgctttgaaaatatatttatttttgtgtaccgtatattaggtgtgtgacccagttgcattctgaatgctttctatttttttgtgttttcatgcaatttttgtttatggtctttaaatgtgcatttcagtttatgttttttctttcttttttaaattctggcactacagatggcatgtcacattgaacaatttgttctaaagaaactggaagtttaagaaatgttatagtaaatgtattcttgtatattggcgtatatgtgtatacacgtgactagaccgtatatttactgcatagaagtctaggcagcagatgatatatacacacctgtagcgataaacaccattcttaatagtacagctcagatgctatctgtgccctaatatgtttgaacattttcatgcaaacgtttgtgccacaactcacgtctctttcccgttgcagttgagtgcacacttgtcagagtgtgtcaatgcccccagcacctgtagttttaagcgctatggctgcgtttttcaggtcagtatccgacatttgtccttcccagtcactgacattctgccatgagagaaagttattatattaacattttaacatgcaagctctggactccttattctttgtcatgaaactgaaacaccctgttgcatgggtgacgaaagccacatgcagcaggtgggatgctcgctttccagttggtggtgctttgagacttcagggagacactgtgctgaggtggaagttaatacattaagagaagtactacatccaaaaccagctagtaatgcaacaggtagacttgacatttggtggggttttcagatagattgttacggaaattttagcagttacctgaatataagcgaatatcaaactgagcatagtttcaacagcgtgtgtgtcagtacacagccataacgatcacacacgtgtgtatccataaatgcatttgatgtacatgtctgtgctgactctgaccccaacgggggacagacgcaaaatggagcacagctcatagagagcacacctccccgagaacagtgtggggagggcatctctgttgctgccgcacatgtagtgtgagaaatctgcatctggtgttttgttgttgtttattttttaacacatctgagattgctagtgaattggaactgagttttcatttaaatatatgtatcttaaaactatcaagaggcagtatatgttacaattaaagtattttatattttatgtagcaccaatacattattatgaagtcagtacagagagattggcatcttagtattttctgaggaagagaacagccaaagagtaagaatgactgtgccttcctttgctttagtctctaacaagactgagcctcccctgttctgtcgtacgtagtatcattcattctctctgtgtatgtgtatatatatgtttatatattgcaacacttatatcaacatatatatatgaatattctatgtacagagtatatgttttggagatcattaaaatgctttctgtggcttcttaattttctaatagcaaaacaaattatatttcagacaaattattttcttaaatatatgaagtacaatttcatgtgcttattcctgactctaaaatggtctacatcttatgtactctgtagattgtatttgttttgtatgtaacttttctaagaatactggaatggtgaagagcaatacatctttggatacagtgtatttgaactaatacattaatactttagtaaattcttttgaatcctgctttgcttacgtgtttactagactgttgtggcagtatctcgctacaactacaggtatctaaacattttccacttatgctatattttaatgggaaaaatagcttataataggtcaagaatgagtttaaaatttaatttcttgatattacaagtgtcaacccttgataagaagccacttgagatgagctgaagggatgcggagataaccctgagatgctcactgtggcactgcagggtgctggctctgctgctcctggcggcctcctcacctgcacgcagtagccaggtggccctgagcacagccctccttaggcgcagagattccctgttcacttgacgcaaataggtctcccctctttgtgtttagtgctgcttttagggtcgtatgttagccgttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtcaaaaaaaactctgtgtgatcttgagcttataaatgaaggtgttttatttttgttatttgttttttaattgccaagcaagtgtgaagtgcttttttaaagtcaatcacattgtgattattttagcatccatccagcacagagatgatcagatgcccagtccccaccctgctgttttttttttgtaaacaaagttttattggaagacagccatccttactcactctgtgttgtctgtggcttcttttgctcgaaagcagcagagttaagagacatgtggactgtaccgcttgagatactgactacttggctctttacagaataagtttgccagcccggacctgggtggttacccctctaaatgcgttaaacttctgtgttttttacaagagacaaacaggaaaaaatatttgatatgattacaattgattttgtcatttgacaccttgtgaaacttggtgcgctctccacatagacagggccacttcccaaagagactctcccatgctgttctttttttttttttttttttttccccaagacggagttttgctcttgtagcccaggctggaatgcagtggtgcgatcttggctcactgcaacacctctgcctccctggttcaagcaattctcctgcctcagcctcccgagtagctggtattacaggtgcgcaccaccacacccagctaatttttgtatttttagtagagatggggtttctccatgttggtcaggctggtctcaaactcccgacctcaggtgatctgcccacctcggcctcccaaagtgctgggatgacaggcgtgagccaccacgcccagcctccatgctgttcttaagaggccttcattgcaggcctataggcgcaggagcaagcaccttcctccagtaatgctggttctcagtggagtttgttctgtgatgttcagctcagtggggccttcttttcatgagaagatgaaaacctctaagaatggatagagaagaagttgttataggatctaccattgtggcttaattacaaaaatataaacttaattcaatattcaacaaacgtctattgagaacttgtagtaggaggatactatggtgaattagaacagccagtggagttgacatttgagtttcgtaaagatttgaatgtcttgtttccagtgttaaatcccagcaatttaaaatgtaaatatactgcaaggagtctaaaattttaaatagaaagatttccctttaatctgccataagagagtgtttcatgtaaatgcgtgagctgagcttgagaagcagcaggaggatcggcatcctgtgcacacacacggagcagaacagcgctgatgagcagcagtgccggactcatattcgcagaatcctagccatcttcccgtgagcatagagcatctgctctgagttcaacaatggtttacctaggaatcttttttttccctctttttgaagctggcattttatttctgtctttttaaaattataggcatagatcacaggctttttatctttcatagatgctgtgtttctcatttagaaggttcttcctttcattttaaggataggctttgtggccgggcatggtggctcatgcctgtaatcccagcactttgggaggccgaggctgaggctgaggtcgggagttcaagaccaagctggccaacatggtgaaaccccgtctctaccaaaaaaaaaaaatacaaaaattacgccagcatagtggcaggcgcctatagtcccagctacttgggaggctgaggcaggagagttgcttgaacccgagaggtggagtttgcagtgagccaagatcgcgccactgcactccagcctgggcgacagaatgagactgtctcaaaaaaaaaaaaaaaaaggaatgggctttgttactgctgtgttagatacacagtagttgaacaggtctgcagcacatggttatccagcaggatggttgtggaccgtggtgtcatctggcagcctttcggggcctaatccctgtggggatttggctccttccttcctgttctgtgctcttttccccactgaaagtgaatggtttgcatcattggaaaccccaggacataccagagcagcctgcccacacacagtgcagcagtttctcactctgtcaatgcctcatgtgtttaaactatctccagccaagtcacgatggaagccccgagagtgcaggatgcataactgtgcacttccctcttggacgttgccaaaggactgatctctcccggactctgtccatcagagcagagtcctcgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattatttagttggaatttcttaggttattttgttcatctgtcttagaaaatagaatgtttgagcgggttcacaaagactgatcctcagctgggcgcggtggctcatgcctgtaatcctagcactttgggaggccgaggcgggcagattgcctgagctcgggagttcgagaccagcctgggcaacacggtgaaaccccgtctctactaaaatacaaaaaattagctaggagtggtggtgtgcgcctgtgatcccagctactcgggaggctgaggcaagagaatggcgtgaacccgggaggcagaggttgcagtgagccaagatcatgccactgcattccagcctgggtgacagagtgagactcgtctccaaaaaaaaagactgatcctcacattcatagtcaaactaaagaaaaactgcaaaatctggacttaaaaacacccattttatattttaagagagcttaaatggaggggaaatgtaaagcccaccaaagtgggctggagtaaaggatgttctcattgcagagaacctcggacctcctgggccggtgttttgccggctccttggaacacacctgccaggtggactttcctgtgcctatggcatctccctgctagaagagtggaagcagtgatctgcaggacctgggagttggattcttcgattaaataaataaataagtagtttaaataagggaagtcctaaagtgaaagaagttgagtttagtgtggcatgatgtgtgttcattgctgtaagctgcttctgctcatactcaactgcttgatttgttggagagcagtggcgcaattatggctcactgcagcctcgacctcctgggctcaagtgatcccatccagcctccccagtagctgggactgtaggcgtttgcaccacacctggctaatttttgtgtttttttgtagagatggagtttcgccatgttgttatccaggctggtcttcaattccttgggctcaagtggtccgtctgcctcagccttccaaagtgctgagactacacgtatgagccatcacagctggcctattgacaatgttttggagacattactgagattttttcaaaagagttggcatacatgtcatctttttgcagggatatgagaataaagagtctgagaattctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagacggtgattgcttcaaaagatgtctcttgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagatgggggatcaagatgccctttgtaaaaatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctctcattatgttggcagagctgttcaaactgcagggtgtggcccctgggtggatgtgaaataatttagtaggttgtgaccagcattgtttatatttatggggtacagtgtaatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgagcttgacttttttagatcccacgtctaaatgagagtgcatcgtgtttgcctttctgtgcctggcttatttcagttagcataacatcctccagggactagtattttcttaaatgaaatggaataaaaaaaatcagggtgcattgtaaattattagggcaagtacagctttatgacatctgttttcagggatacacacacacgttggtataagtggggtgatacataagcatctgtttcttactatgttacctggtcaacaattgaaaaatactctgataaaagatttgctagtttttagcaaaaacttgaaaaagcatctgatttattctgaaattcaatcagccgctgcactttgcctcaccctaattactggaagagattctgagaaacactgtttatagcattccctattaaattaggactggctgggtatggtgactcacacctctaatcccaactctttgagaggctgaggtagtaggatcactttaggccaggagtttgagaccagcctgggcaacatagcaagaccctatctctaaaaaaattatttttttaaagcctaaccagacatggtggtggcatgtacctgtaggcctagcttactcaagaggctgaagtgggaggatcacttgagcccaggaggtcaaggctgcagtgagctatgattgcaccactgcactccagcctggggacagagcaagaccctgtctctagaggggaaaaaaaagaaagaaagaaaagtaccaggactgtcattttctgtgtgaagggatttttttcttctgaaactctgtcaataagctaacagaaggcctatattgtgaaaatttaattgatattgttgttaattaatatgaaaaccacttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacaggtaagaatcttaggactacggccagatcaaagggtggaggagcttgcctgtgttccccttaagggtttcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgtagttatccagagagagaaggagaaaacacaatgaaacattagattgtattagaaaaggcacaagtcattagcattaaatcaagccaaataaagtacaatgtttcttaaaacaccaagcctcccgctggaagcccctagcattttgctgagggcccagtgatgtgtcagtcatcagactggccaaggcgactggtcaggccactgctgcggggccctggccatcctgtggcccgcctgcacctgcgctccctggcaagcagctctggctgttcatgagattattgctgtgttttgacctggggctcagagaggcactggaaaggccggggaaatcacctcttaaaatagccacaacagaaggaagaatgcacaagtactggattcatttacaacaaaaagttagaatatacacagtgatgtaccaacgccccatcccaaacctcacatttcctctgcattcatcttcagtttctccccttccagtcaggtgttgtcatttactttcctttttagtcgagtttaatcactctatggtatgtgatttctacttgaaaacttttgtgattggatgaaccaatgaagcataagtcagaaagaaagggggaagccaagttgccaagggcagagaagtgaggatggagtggtgacggcagcggtcagtgtcccttgacctgtgacgagtagaaggtgatggcgcacctgcctcttccccacaggaggctgggcgtggcggagagcaggttgtgtttagggaagggactcagagcaggctgcccgcgcctgattcccctgagtgcagggacacggctctgcctgaaacatgtgaaaactcttctccatgtgacctgttgagcaggcgtggtctacacagaaggtccttccaaccgtgtggttttttgaaaggggaaattcagtgttacctttgggaccactgtggggttggtggtctttggccaggaggattctgcactgtccatcctcaggaaatgctgattgaaagccttctgatgcccagaggtgctggctgtgtgggagctgcacggggccaggccatccctctgctgctgcaggccccgcctaccctcttgagcagcagcccagctcagccgtgttccccactgtttcatcctcagagcccttcctgttgccccaggaagggtttatcgtaaaatcttactgtggcccagaaaacctctgtgcctggccaccggtcaccttcccagcttcgccccactccctgcgctaaagtggacccgctcattgttccttgacaagctccatgctgctgcacagatgtctttttctcctgcttcccttcctggccagctccaggcactcctccagccatgtttgtggaccagctaggtgatgagggcacacgtcacttggggtcttcttctttcttccttgtctgattctccagtagaccctaaagccctggtgatggcgggagtcgaagcacagagggcccgatggcctggctgtggcagtgggggtgcaggcagggggtcaaggagtggaattcaagagtgtctttgcttttttgcctgtccggggaacgatgagttcttaatattttacttcttaaatatcctgtttttctttattaagaagacagccaggccggatgcagtggctcacatctgtaatcccagcactttgggaggccgaggcgggcggatcatgaggtcaggagatcgagaccatcctggctaacacggtgaaaccccgtctctactaaaaatacaaaaaattagccaggtgcggtggtgggcgcctgtagtcccagctactcgggaggctgaggcaggagaatggtgtgaacccgggaggcggaacttgcagtgagccgagatagcgccgctgcagtcaggcgtgggagaaagagcaagactccgtctcggaaaaaaaaaaaaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggcggcagaggttgcagtgagcaaagattgcgccattgcactcgagactgggtgacagagcaagactgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgagagtgaggcatcacagcaggtgacacggttgcagccctggcatgcaagtgtataaggctcacgggctgatgctccctgaaggcaaaccttctgatttggattgttgatgtggagtgcagtctgtctcttcagctctgtgtcggagtcttttttctgtacaattccatacctgcacttgagatttattttttatagaaactgcagtgactgagtgtagaccgttcttcaaggatgaaatcacgtttgctgcgttttagagaacacttgatgtgactctgcgttctgctttgaaatggtgccattgatacagatgaagtgcctgttttaaaaatagcccgagttcccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgggactcatgcttcatttcggggtttgctaagttacaaagggcgtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagggacagtgacagtggaaagaggtgttctttagagaaattatccttactttttagaggttaactaatatcatgtttcttggaaagaacaggaagaataacactgcttttacgcccaaaaagccacccagacctgtcatgtttgtgtctttgtggttaataacagccagcaaaggtgctgaaacctagatgtttaaaaatagacttccaaaaggagaagtgaattcagggggccctggggcccgcccctcgagcacccggtgtggccctcagcttgtgaggtggctcagtcattccacagctgcattgagcactgaactctccagccatcacaagctgcttgaaaatgcacatcattttttgaagtgaaaaccctttaagtccctggcttcatctcacaggtggacactccagccccttaacacagactgggccaccagggcggagtacagctcccacccctccaggtagtgacaaatatgagcagcctgtgtgttttgggaaagggctttctgaattagttaaatgaagtagcataaagtcaggcctggttactggcagcctcgtgtgttcgtggcagggtttctgcgttcctgcctccctcgctggggcctggcagcctgagtgtggagctggagggggaagacccctgcgtctgcagcatcggcccactgggtttcacctagggcctgaggacatgccttggggccctttcctgccaccatccaggtgggaggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacaggggcctctgactgttctgctcctagcctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggtgaggcaggggccggggccgggccagcagtgtgcatctgggccccgggcgagtgctggggcggggtccgtgggatgagggctatgttaggtacatgtgccttaggacagttttttctaattatgggtaacacgcagaggtgtgatgactttcctactgaaagtcccccagcaaagacaaacgtttcccgcgcaggcttgtcccctccgtgtgaggccctacatggtgtagaaagtaggggcagctgcagccacgggaagctgcaaagccctcctgggagagactggccgcagggtgacccacaggacaggcccaagcgcagatggcagaggccaggacctgctggtcggggcgccccagaccccactcctaagggccagggggcagcagtcccaccgcgctctgccagcatgtttctgatccacaagcagatgtgggcctatggctttggggactgaaagagtattgggaatatttacatgaggaggattaatggcagaaaggaacacagattaccggtgtgtgtgtggggccggatgaagcaggcagagaatgaggttggaggagaggggagcagcttcgcctccaagagagcagaggccacctgtgggtgctgaggccggagggaggagtggggagagcacagctgtctcctgctcccaggagctcccaccagcgggcttcccaggaagccacagtggagcactctgtcttggaccctgcagtgaggtgtcctttgacacacaggcaggtcaaccgcccaggacatcccctgtcagcagtctgtgcctagtaatgtgtccagacagacagggctgtgggcatgagagctgtggtagaactggggcagggacctgggctcttccctgggaggcggtggcctcaggacatcttctacacagttttgctggtgttacccccagaaaccacagtgatttttatattgttgcttcagatgctggtatgactgggcatggtggtgtggcctatagtcccagtgctttgggaggctgaggcaggaggattacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagtgagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgcagtcagctgagatggtgccactgcactccagtctgggcaacagagcgagactccgtctcaaaaaaatgaaataaaataacgagtgctggtgcagctttgctttcctaacctctctgacgttcacctgtctcattcaccaaaccctcctcacctgtggcaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctca

SEQ ID NO: 1174 - DNA, 134023 bp, Homo sapiens; identical to SEQ ID NO: 1173

SEQ ID NO: 1175 - DNA, 134023 bp, Homo sapiens; identical to SEQ ID NO: 1173

SEQ ID NO: 1176 - DNA, 134023 bp, Homo sapiens; identical to SEQ ID NO: 1173

SEQ ID NO: 1177 - DNA, 980193 bp, Homo sapiens
tcaacgactcaagatttattttcattataaagaagggaagggaaagcacaatgagaaataaagagaataagacagcaactgaaaaagtataagatttatcaaatccataagcatactactaaatccataagcatactactaagataaaagcaagtcagagtaaaagatgttcttatcagaaaacagatgactacatgttatagcacctgagatttattttgaaataccttatgtctgtcatctcctacaatctaggtacattatattttacttcggtagtatttcttcttaccaaatacataggcttcaagaaaaaacagaacctatcaatcatatcagttttaacttatttgtaacagtctgcttttttcttggaacattcatataaaactacgatcaaaaactaaatgtaaatgttactgcatccacatgatagacatgcctttggtttaagttgggtatctaattttcatgcccacatattcccactaaaaaagagattaaaattacttacttttcaaataaatgtagaacaaattatgctactttgtagtttttaaaaagtaaggtaaatctattatatgagtgagttagtagtgatgaggttaatatctttttaaattaaaaacgagaaaaaaaactgcatttcattgaatttggggtaaaataatagagtcttctttgacgttcaaatttgatgttcaacttgaagactatgatcaacaagaggtttgcccgactaaaataagaaaagcaacattacagtgaagtagattgactgtgagattgtttttcagttccctcgacaatattgttcaaactccccttgttttgttcagatgtgatttccatatttgttacttctgaagggcacatagtttgaagttctgaaacatttgtgcgtagatagtttttttctatttgactgtacatgttagctactgatttttcaagttctgctaagtttttaacgtgtctgaggatgccttttggttctctctgagggtctgttttacacactgtcgttgttgatagctgtgtcatagaggacttaattttctcggcaggcatcaagttggtcgtgcatttaacacctgttatacagacacactctgtggacagaaatgaagctgaaggaggtggagggcaaggaatagaaggaggtggtggaggaagaggagttggaaatggaggtagaagaggtggtgttgggggaccagacgttgaaacggaaagtggaaaaaatgtaggaggaggaagaggaagagggatagaaggaggagagggaggaggacaaaaaagagaaaaaggagaaatgtcaggaggaggagcaagaggagcaggagcaggaggaggagaaggaggagaaataggaggaggagggggaaggggacaggcagaaggagagatgtttggtggatgggcaaaattttcaaaaatatttctttcggtttcaataggtaacatacaaataggtgtctctctcctagagagtgaagaatgtaaaacacaaggccttgaaggagaaagttccaaggaacactcagcaggagaactgatgacattaggttctgatttgagttccacagttcttgaaacagttggcaaagtggagaatgagaagtgaggcctgggaaagcaaaatgaagagtctgaagagagagatttcaactgttctgttccttctatcatcagtgtttcaccttgccttatttcctctttctctgtcaaatttgcctcttcagttgtaagcaatggattgctgctacctcttttgtttgtacagattccagtgttttcattttcagctttctgcctggtgccttgccactgctgcagatctatgatctctggtctatttggaactttcctcatcagcctcctgggtaagctgactgactgactccacagcctctgaatcttttctcttgggcccctcagagacttactcttggcttgtattttgggtgaaaatgggtctacaaaatctgttctctgtgaaatgtctgaatttgttgatacttgacttatgttttccttataaaggggattatgggcacttaagtcatcctcatcagatagaaatgtgaattttcttgcagacttcagtttgttgctcttaagtgatccgtctacatgagctgacttgtgagcctcaatagtattggaagaaaagggcatcacaacttgttgatgtttcctgtcttctgagactgagttatttcccctgctttgttgaaaatggtagagaaggaaaagacttgaaagaaaagaagataatgaaatgtaaggaaacaagttgtgacacagctttcatgagaaagatgtttttatggctctcattactattaaatacttaaaaacatcaaaggccaaacaacactaacctactaaagcaagacattattttaattccctgctcttagaaaggcagggcagaaaaatcttagagttgtgagaagaatgagaaatgtaaatgaaaaaaaaagtactcatctctagattattttggaagagagtattttttgtttttgttttttttcagctagtgtgatacagcaaagcatccatgtccacacgtaacagttcccttatgcacaaatcacagttcttcccattgcagaacaccatccttgcctgaggatgctcagggctgcctgttacgcatagaagattcttagctgtatctgattcagtacttctgtcctagagccaaaagtaatctcctctctgagccatcatgtggaatatcctgttctccaaattaagagaattaaaatcaccaaggacagatgggagtttgtctcacagcccaaaaatcacaattgagaaattgaatgtatgctagaattgtgacagaggagtttttcttctgtttaaattttgtgcttaattagttttaaaaccttatacataataccaatcaggaaaaattgttttaaaaccttataaatagtaccaatcagaaaagatgttgtcagtaatttcttagactgatctggatcaaattttacttaaaactcaccttaacaaaaagattgatgctaaaaaaaaaaatcactttttgatatcactgaaaggcttacttatgcacggaaactgaatcataggtagttgtgagtcataaataaagttgcatacatcaaagatcacaaattaaatggctctaaggaaagcatttggacccttctcccaggattgttggctgattgataggtggttccgaattctcattagcttttactctcaagccaaaacagaataacatttattttagttactgcttaatatttacccacttagcaggaatgaaataaaaaagaaatattctgaatagaaattaactagccatattgaaaaattagggtgatagtttaggcaacaaaataataaagccacagttgttaatgtgtcttttggcaaagatacgaactataagaaagagaaagaaacaattcacacaggtagacctggagcatcaagcctacttggacaacaaagaaaattcagacaatctggactaatcagagtgcaaacaaacacttttactcttcgaatcttgaaaagtatttttcaaatatggcacgaacaactgggattgatattatatactggttgtttttgtaaacaaacatttgttcgtggtttgatttctcttggtaaagcacccaatggatataacaatatcacatcactttgactaaaagaaatctataaataggtttctatttatagatttgtaaattttaagttcttaaaatttaagaatttttaaaaactaatttaaaaaaattaaaaacaaggagaattttgaaattcctttcagtaggcacaggtaccatcacagcgaacacatgttttaagctcatgccatcaaaaggaaattgggtgtggaagacaaaactttccttttaacagtaagtgagtctgtggcaaaagatgaagatcactgtatttacagtacaacagcattttaatctgttctattgtatctatttttctaacgctcttctattagagtgatattatttacttacttatgcctatgtatccacaggtgagaaacagaaaacatgtgatagaaaaaaagaagtttttactagagttaatttaaaacaattctgaaaatatgagcaggaacttgctttaaacaaacacttagtacgtatatcaaaaaaaaggcatgtttttatattttgttattattcatatgaatgacatttaatagtagatgaaatcaaatgacattatttgaatgtcttttcacagaaaattgtatctaataaagtctgtttactatacatagataaaaattcacttctattaaacctggatgatgccaatcctaaaataaaaattttaaatgagagtttaaaaattgcttctatgatgtcttaactctgtaaaactggttaatgcacactgacttttaaagtagatatattttgtttggaagaaagtaaatatacaactactatgatgacaattaattacaaagtaattatagcattcataggaagttatcatacgaagttattactttgtgaagtagtttttccaaaatgatctttgactttgttctttttaagataattgataataatcatttaaaactaattcattttctagtaacttaatgcttagaattcctgtaaaaagttcttgaatagatagataggttaaacatttactaaagataagataattaaatatgtagaacttacttaaactatttcaatgaatacatatattacaattgcaaaatctactgagtctactacaattgttcaagtaaaaataatcttaggtattgctatttgaaaattactgtcatcaaactatgctgattccagatgatgttatagtatacctgttcttattaatttaaaatgaatacataattcattaatttcatatataaacacacaactttacacataatccttttttttagtttctaaagatctttgcttgagagaggtcattaacatactcaaatagaatcaaatcatattggctcaattcctacattcaccaataattaattacaaaagaaacaatcatttttcaacttacaaaaaaggtgaaagcatatatctaaagcatgaaccctgtattatgtccttattttggaaatagaatgtcatgctttaacctattataaattcagattttgtgttaaaataatagcattaagatcaattttaacattaatacgactatcctaaacaaaaccttgtataacattattaatatggtaagtaacctgaacacatttgtttaaaaccagcttttccattaccaggtcaatttcatgattttttaggcttttcttattgctactagtaactgatacggatgtcacatgtaataacatgttatagtccttctactccatcaaattccagttaataaaaggttttctggatttaattgtcatattcaaaattgtaaaatattcttggttgttttacatatcatgtccaaaagcagttattcttgaatttttaaaatactgacaaactgaacatcaccataaggaatccaattatgagggtagcatcattatacaagcaactgtgaggtcttttaacagttaccagtgtctttcaaaaatgtatgattttttaaatagtgactacaagtttcaaatcgtgcaggagaaatattcggtaatcaccgcagtctgagagtaataaagtgaaaaaagcattttctaagtagttgggaatttaatatagaaattctgtaatttcattgagattttaatttctatatcatataacgtcctaaaagtagtatctcagaaaatactacgattttaaaccagagaatttggttttgattaccaaatagggatcggtttggatacctaatcaggattactattttatgattgtgctttatttctctcgtctcctatgcaaaaatatatttttcagaatctatttatatatttatacatatatacatatacattatatatatgtaaaaatgcatgaccctgaggattgagatattaaatattatactcaagctataaatgtgcaattgtctcctgaagttgaattctgcttttctcttagctttctttaatttctggtttggttttggctattatttttcaacttaacctttcttagattttcgtcttaacaaattttctcttgaaaataatagaataaaataaatagtccatgtaggcatttccacatcagattgaaattaaatactcaccacacagaattcagtaaaacccaactacttctcagagttcctgaacggtctacttacattgagctgtctccaagttcttcatagagatgcgcacctggcggaggcggcggcggcggcgggggcgctgccactggtgcaggagccggcactgctggtttagccgcgggtaatgcggcctgaattcgtgcagtctttgtacactcagcttgacgtcttggataaagtaaggatggcttgtaaaactcattttagaaatcataatgcttatcaataagccaccttttaataatggggtccagttatcaggggaacccactaaaattattttacacaaacatcaatttataaacagatgtaattacaaaagcatccccacagggtatcatttgcatataatccctgctttgttcttgaaaatagctatctcttgaataaggggtagaattcagcagacatatttgcaaattaaattaaatgataatcttagagaaagcaaaattttaattaaaatgggatggataattaattggtagtttaatgaatctctttcataagatgaggcatattaaagataagatagataatttttctttattatttgtcttttaaagttatttgaaatgatttgaaacatttttgacgttatttcacagaggctgtacacacatgtacaagggaaatttggttagcttgtatatcctttaagattcctaggaatgcctaggccgggcacggtggctcatgcctgtgatcccagctactggggaggctgaggcaggagaatcgcttgaacccgggaggcggaggttgcagtgagcccagatcacgccattgcactccatcctggccaacaagagcaaaaagtccgtctcaaaaaaaaaaaaaaaaaaaaaaaaaaaaaaaaaattcctaggaatgcctgtgattctcatgttacagctacactgctgtttttggatttcctggacactgattaatttcttcctcaaaaccaagatgttacaggatggaagctataggcaaactatctttttcacatttgtgcaagttacgtccaattgtctaaaatcagctcaattctatatatatcaaaccaagaaataaactattacaaacgcaaaacaagggaataagatgtggttctgagcaggctgacttgattgatataatctcgggtttctcttttcctattacatgaaaaggatgtgtaaaatgttaattatacttacactttaaacctgtttgggaaagcaagagtaagaaaaatagaaagctacattagaactattgcattaataacattttaacatctgatttattctaaatcatgaataatttatacgttaaattcataatgacagagttaatgacagactaagaaaactaaggatatcaattcaaaaggtgaaaatagtatcgttaccgttagagtcattcaagccattaaaatatccataacagaaaaataaagaaatgaactacatagaataagaaaactggattaaaatgtaaatgtgagaatttcaactctagtggaaaaatggaatattaaagatgacctgacctttataattggcttcttggtttaccctgcttgaagaatattacaggaatggagagaggtagcaagccctgattatactcttggcttcactttgaagctgaagctacaattggaaggtcctactcttgggtaataaatttatgacagtttttacatatttgctttttagtttccattcatagaaaagttcaaaggcatatcattatataaaaggatagctattcattcttaccttatttgcaagcaaatatcaaggtacaaatgttaggtctttaaatattagaattttactttgctatgtgagcagagaaaaactcattttgtttaattatgttaatctataaaaagcagtaactaaattcatatggtattgagctgattatcaaactaaaggagaattaaataatgcgtctataaattatttaaatattaaacatctcaagtatttgttgtatttcagactaccttgtataacatccagagcgcttcagttttgatcattgcatactgtgccaaatacaagaatttttctcactgatttgcttgctagcaggatataataaagctcctttggaaaatagttaagtgtaaaaagataactggtaatacggaatggatttaacattataattaataatgggttgatggcttaataatttaaaacaatttgttcagtatcaattttgttcatcagctttagatttagcatatcaattgattggttaaggacacattaagctccagtatatcaaccttaatgctgtatttgcaacttcacattgcttttgaggtagaaaatatttctgtagtttcaggttggaattacttgaaaagtaatgacctgcttgaaaaatattaaaggaatggagtcatgcagcaagccctagttatactcttggcctcactttgaaaacggagctagaattggaaggtcctacttctgtgtaacgaattcatgatactttttttcatatttgctttttagtttccattcatagcaaagttcattcagagcatacatttggattttcaggttggaattaccttaccttattcaattcacaagaaaattttaagtatttgagaacaaagatgacagtttaagaatacataaggactattggctgggcgcggtggctcacacctgtaatcccagcactttgggaggctgaggtgggcggatcacgaagttaggagtttgagaccagcctgaccaacatggtgaaaccccgtctctactaaaaatacaaaaattagccaggtgtggtggcgcatgcctgtaatcccagctactcaggaggctgacacaggagaacagcttgaaccttggaggcagaggttgcagtgagctgagatcacaccactgcactccagcctgggcgacagagccagactccgtctccaggaaaaaaaaaaaaaaagtaaagaatacataagaactattttagtatttcctctgtaggtagtttaaatgatgaatagcagttctaccattatttcttattgtttattacataaagtaatttacatgatttattattactgtctgctatttattttctttttgtggcacactcagggctacttctcttcttaatcagctccccaattttttcaagtcattgtctatagaaatatacttaaaatgtgtggctctctatcacaaagcttccccagacctagtgtcaaagaatatattactaacctacttcaaatatggatgtttaaattagtgataattacttgactactctagataagttaaatacaattttaaaatatggatattgtcaatggatgcacttgactgcaggaaccagaaaaattaagagcctgcacagccagaacatgctgtcaaatagtacactaaaaactctggcaaagcacccaggaaggaagaaaccacatagaaaattacatcttacatgctatgattttacaatgcttttgctaacactgtgatcatttgcacaaaggcaaatttaacagtttggataaaaacctatcatgacaatgtcgcgaagttattgaccttcctttggagctgggcagagtgggtatccgcatatgacattccattgcttttaccccaggatacctgttaccttctctcccaagttggctcttaaacaaaagaagagcataaacaaagccacaggaactaaggtgatatttctattgaaagagaccgaattagaatcacaggaatattgggccatcagtgaaaaatgtactgggagtttgtactgttttccttttgaagaaaatcatttggtacgagatagacagacagataaagcaatctcagagtagttgcaccatcaatattttacaacgcaaagccatgttaccagagatggttttctgcaatgacttctgaggaactatccaggtttaccatccttgaatacttactgtctgtagctgaccaaaaccaccaagatggcaggaatgcagcagaggatgatgatgaaggccagagccaacaaggccccttctgtgtatcctagactttctcctctctttttaatgctggtcactgcctctggagtccggatctccagaatgcgtcctccttccccataatacggctgaaagtctttattgatatcaagtagtttgccatccaaaaatctttattgttagataaatagtaaaattaatgatgctagcagagaaagagcattttaaaaataaaatctttttgtaagatctttcaatattttctctaattgaaacacaagctgagtcagaagtctcatgaataataagaaaagcatatataaaaagcataagcaataaagaagaggagtaattacacatctgtatagaaatatcaaaaatattttaaaacacagctcttgatctgcttatagacttaaaaaatctaattatcagtatcattaagcttaatattactgtgtcaaaataatttaacaacattttagatggaataaaatataatatcctaaattatataccatagtttatatttatgcattttatctccttgggtcctgtaaccttcaggataaccctgtaaagatcaaacattacaatactgatttattgcaggccaaaaagctatacagttataaaaacaaatctgaggcaccaaactaagatttcagactcaaactctgtatttgtttgccataacaccatcttaaaagtaaacattctcaagtttcaaaccaaaagaatgttttatggtcaaatggtgaagacatttaaaagacccttctgcctaggaaaaaaagactaaataaatgatgcgagtagtatatcagtgttgtaagaatgacaggaagtggtagtcaatgtaattccttcctctaaataatgcaattccaactatgagtcttgaattttggaagagaatcaaggaataattattcctaatcttatgagattgaaaaaatttgttatgtatttaatatcataattagcaggtgattttttaaacaattccttgggaacttttgaacagtcccttataagctctacatattgatgcagcaactgtgttcttaatacaacaacaccataaaggtcaaacgtcttactatagaatattggaaaacaaaaatagttcaagaaaaacacaattactcatagtcccatgatctacagacagtcataatcacttctaacatcttggtatatttaagtctaatatttttttggaggggtgatattaaatattttatatacttgagtatactgcatatataaagtgcttatgttgaaaaatacagaaaacacaaaaaaatgcaaaagaaaaaattaaaatggccctaaatttcattatcaaaatataatcaatgccatgcttgtgtacttttttcagtctattttatgcccttttgagacatttaattttaatattcagagtgaccatgctgattttaaatcccgttaacacactgttcattgcttaaaaatagaagtgcctggtatcacatatgaattccatcacatatgtaactcataaactaattcatatcacacatgtggcaattagaatgcttttttgctttttttaaacagatacgcttttatagattaaaaatgtactttttatagcaattttccaagctcattgttacacgttaaaagaaaataaaaatttagccatttttatgattactagaaatagaatagtgaaacttcttgtttgaattgtttattagataaaggaagagattctaaatgatgcatagatcaagaattgcttcacaggaactatattattagaacaaggaagaatcagatccagaagaggatcattaatttaagggaagaatatacccctacaatgtggagttcagttgacagatcaaaattctattggattcctggatttcatatccaaactctctaaagtaagatttgttagtctttttacactgcaagagccctattacttagatacttattttcacttatcaatgtgatgtcataaacaattttttactagaaggatggatcacttttgaacccacacctgatctagactatctttctttactttgtgtatttaaaacaacttgtctgggtaaaaattcttgagtcataacattatcccttacaaaacagcaaaattgcttccattgccttttgtcattttatcatgcaaatgagatatgcagggcttacctaatttttgttcctttatgagtaagatatttttatttctgtttcagtgatttttaaacatattcagatactattcaaagaaacatggctaccttttcattgatttttgcctgtaatataataaactcttgaattcttttttcgattttttgcttctgttataaatactacaattttaacctcagaaataactgtcattatcaggttgtattttaatcgtcctataaatatattttgatctcttttattatttatatgttttttcctttttcttaatattgcataaattttcaatggatacacttcatgttgtcaatttaattttcacatgccttctcatttcaggaaaggttgaatccaggtgctcaattgattttaggagataaaatttaatttataaattaggcacagtaagatattaacaacaataactaataacaaaatagaacaattatagaactatagtgtaataaaagttatgcaaatgtggtttctctctgtctctgtcaatatcttattgtattgtaccattggtaactgaaactgaagaaagcaaaaccacagaagagggttgactgctatactccagttggactgaggggaaggcactttagattaaagactaccaccgtgtaggaaagggacaattctcacgagagaaagtggaattcttttaccagaaacaggagaaggactcaagccatgtaaaacacacacaccatttcaccaatccataccattctgttttctactaaaaatgttaaactgttttccaatggtttctgtaggagaaaatttccagagttatatattctccctctgggtcatcaggttattatctcctgattttccatatttattttgttttttagtatttattgctgatcccgtttttccactgcttacttatcctaaaaaagagatagatctgcccaaatccagcatcaacacagaaatgtgttttttttttttttctcgtcattttcatctacagtgtactcagttactatatgcaaaccttttgtaattctaagggaagggtatacaggtcccttcccaggatgtagccaacatgaattgattactgctatgttatcctgaaatgagataagttgctaaaccaatgtcatgtcttattattttctcaagcacatgcaaacatgtatttctgcctccattgatggatatggggcctaatgttgtgttattcagcatataattaataaatacataatcaacaatctaccctgcatctcaccttcgtgactgattaccttgatgatgatgattttgatactgcaatgtacatatgaatgtagaaataagtaaagggtgagcaggagattgtactctagacagtagagggacaactgtctatttcctttgtaggtacacaatttaggcgtacagagtgggcagtggttaacatatctacctacattcattacactgtataagatttttctgcttaatcaagcaaatcatggttagatcatcaactattttcttttcacagtttcataactgtttaactagattctaataattagtattccattgatttggattttcagtattttgaatttatatgtatagttttttacttagaacattgaaagaggctttatcagagcctgttaatcagataccgtttaaggtctaagtgtgtttttaaacattgtggtttaaaggcagtgtataaagtctttttctgccttctccatctttctcttacgatttggacatactgtttttaaataggctggatataagacagataaacaagctaaaatgtatttgcttatttttaaattttaattaaactatattttaaagtagtgtgttctgttttgtgtagaatgcagaaagccacaagagaatatggctattaacagcaacaacaaaatgacaaaaaagtgccaggttatactaaaatcataaatttccttgagctgaagtcacaatgtgagcaaaaaaaaccaaattccattgagtgacaattaggataatttcatggtgagatgtgaccatacattgtttcacctttggcagaaaaggttaaaagtggctgccataggctgggcacggtggcttatgcctgtaatctcaacacattgggaggctgaggtgggatgattacttgagctcaggagtttgacagcagcctgggcaataaagtgagaccatgtctctacaaaaaacaaaacaaaacaaaacagctaaaattgtaataaataaggttagaattatagacacccacaaacacaaggggagtctcccctcatttgaaaacttctttgcgtagatttctgtaagatagattgggggacaaggcaggacacaagagaatattccttcatggtgtaagaataggaacaaatcagcaaggctggtgcacaggcagcaacccttgtgcaattccccagacctttatctcagatgaaacaagggccgtaagtattagagggaggaggaggaagtgtgcccatccctggtgctcaggcaaaggtctactgcttctggaaaagaggtataagcaaaaatcccctacccctgggggaggagcaggaagtcctctcaggtgtaagatcttgcaccaatacaaagtagaggtctactatggattgagaaggggcagaaaattctcttgcacccaagaccccctgtaaatgtgaagcagaggatggctgccatgatgccataagaaagagggggaaaaaatcttgagaaagcccataccaaggcttacacatgcaggctgtacaaggagaacagaggaacccctattccatgacccacctcttccttataagagtggaacccagcagcaaggaggagcagtctaacactgtgggacagatcagagtgtgggcagaaacctcttctgtggcacaagcatatagagagcactgagagctgaggactgagtaagaagactgagaaaaccctacagcacgcaggcctctattctaagactgagttgacaccattccaccaataaaagaatttttgaagcttttggcacagtggaagtaataattgcaacagcaaaatccaaataattcctgaatagctttacttaacagagtaaatgtctgtaatgtccatttacaggcataaactctatttacctcacttcttactgttcttccacaccatgtctggcattcaatcaagtaggacacaaaaagcctacaaaatataaaacaaccattttcaagaaatgaagtaacagagccagatagagataacccagatattggaactgtcagacaggaactctgattcaactctgattaatacattgcaaaatagcagaaagcacaaacatgcctgaagcgatggagaaattcagtagagtggtggaaataagaaataatctaatagaaatgctagaaatatctttctaaaaagataaaaagatgaagaatttcttcagtgagttcatcaataggctaacacagatgaatcagtgaattcaaaaatagggcagtaaatattattcacactaaaatacaaagaaaaaactgtgtgtctatgtgggcgggggaggggagcagagtcagaacggaacaaaattatgagaaaaatcaaattgtaattggaatcccagaaaaggaataaagagaaaatgggcataagaaatattagaaaaaatgtctgagaatattccagaaataaaaaaagaaaaaactcaaaatcaaactcacaaaaaaatgcagctccaaagagttgagaactacaaggataaaaaagcaggataagagtaatatataattattgcataaaatctaagcaattcaggtaaccaaaaataaaaaaattaaaataccgataagctggccaaacaaaataagttattaacatatcactaaaagtcattccagtcctgtctatgcatttatgagcttttttatttttgattgccaaaatatattttttcaaatcaaagtaagttcccaggacaaattattattatgatgatttctaatcctttgacctgagcattccaacatcctcagaagcttagattttaaggtgaaaggaaattgaaagaacacttccattgacctggaccggcatcttaatgttctagtacatttatgcagtgttaaaaactaaataaccaataactctcacaactacagaatagataccaatacttgggcactggcattatcagccttggaaaacacacacacacacacacatacacacatatacacatgtatatgtatgtgtatacaattttattataaaatctttcaagaaacaattctagagtttcaaatagaccagtgactctaagcttactataatacttcaaggtgaagactgctaaggcaaaattttcatatttcatggctattctatcttttcttcaatataaacatatattatttatttatttatttatttatttatttatttatttagaggcagagtcttgctctcttgcccaggatggagtgcagtggcatgatcttgctcactgcatgctcggcctcctgggttcacgccattctcctgcctcagcctcccaagtggctgggactacaggtgcccgccaccatgcccggctaattttttgtatttttagtagagacggggtttcaccgtgttagccaggatggtctcgatctcctgacctcgtgatccacccacctcggcctcccaaagtgctgggattacaggcgtgagctaccgcgcccggccaaaaatttattttatgatttatatatattctgttttttccttgcctgctggctatgatagttattttattgaatttagatgtttactgtccataatataatttaggtttggaaaaacttatttagaattaattaaagatgttcatcttgtatttcatggtgtcacttaaaacccaagtggcttttttttccccaaatatttaatctctagaaggtttgctagttaaattcaaattctaatcaccattattttactctttaaagttagcccaaatataatacatatttttatattcaggtaaaaacaccctaaactcaatcaatcgtgaaatttaaaaacaaaactaatgtatgcaaaaaacacagaatgcaggtagattcacataaaaaagaaatgtgttgattttctgacaatcgaaagaatatatatgaattactttggaagtttattcctaaactttttaaattaataaactttttaaattaataaaacttacaaaaaattggcttggtagatctaaatgttgcttcattttggtggtgactataaaatcagagtgcgagctattacttcattcatctatatttcctccacggttagtatcctgttttgcacatggcccaaatatctattaaaaatgaattgatgagccaggcacggtggctcacacctgtaatcccagcactttgggatgccaaggcgggcggatcaccaggtaaggagatcgagaccatcctggctaacatggtaaaaccccgtctctactaaaaatacaaaaaattagctgggcgtggtggcgggcgcctgtagtcctagcttctcaggaggctgaggcaggagaatggcgtgaacccgggaggtggagcttgcagtgagcgagattgcgccactgcactccagcctggggcacagagtgagtctccgtctcaaaaaaaaaaaaaaaaaaaaagaattgatgagtaacatgttaaataattatggcttttaaaaaattttagctgatattaaatcattattttattattgccaaaatagaagtgatgaaattttgtcgatgaacacatttaaaataaaactaaattcagaatttattaatttgaataaaaattgaatagatatttacaaaataaataaatttacatacacataatatagatatatttgtaaatgtgtatatggatatgtttatatgctgtttaaaaagtatagacaaagaaaaactaaattatgatgtttcacatatagagttcggcatgactatatatacaggcacatataaactattatgattgtatatcaatatatatttttaactaaaaatgtttcattgagatagaatttcattacaagacccagttggacactaggtgtcaccagagtaaagaaaattctgttaacaatttttttttttttaagtatttaagtgtgctcgaataacatccaaagaaagtaagtagcaggattttctttaagattctgcactttatttatttttaggatttataactcaaatttttaagttcctgctaggatgaaatttcacatagagcatgaacttaaatgggaatgattatcccacctgctctccacctgtaagttaaagaaaaaagcagatattgatttttgctgatttagtagacctgtaagaaaggtggatttcttcttaaaatgcaagcatatgaaaatcattgcagaaaaactgcctctttaagaatctgtgctttcctcattaatagccagtgcccttgagcaagagtgaggagctggcagcaggtgatttcaaggagctgttccttgttcttaagtacaaaaggtcatctgatgcccataaagaaaatgggccctctgaagtcactgtagcccacacttagacctgaaaactttaaggcatgagaatcctaggtatttcaggttctttgcttacacttcactttcagtaactatttggtgggttttaaactttaagtacttatagcctcaagtcagaatcatctatggttgctattgtaaccaaagagctgttacagataacaaaaagcacttacttaaaaagctcatttctatcgatggctctgttggtttgggggtcaattgcatagacagtcaagtcacatttggtgtaatcttctagggaaaaggcatctccatgccggcgagctccaatggactccactacgaccttggcaccaggaatttgttcctgaacatagcgatccaagatcctataaatcaaacaaagtacaaacatgacagtccaatgggctttctgggagtaaaaaattactcttaacttgaaaagacatttagtaaatgaaaaatgatgacagcctagttttttgttaatgtttactgaatataaacccttgaaaaacattctctatattttttcagcatttagctcccaatgatgctagaagctgaatacggtagaaaaggtcaccaaccatgtcctatttaactttaggctttttgaatttatgatactatttgagcttttacatgagaaatgccaaatatgctgtacaaataaagctgtctatgctttataggaggcatggggtcttagaacccttgacttcacatggttggtgtcataaattacatctcccactaaagtctgtgacacatgacacgtagctatatgctaagaagcaggactaggatgcctgttttcccaaaggtataaaaatccttgcagaatcacagcaacgggagaatgtggagatattttgcaatggcaggattaccacgttaagataaaaatatggcatgcaaatctcagacactatttaggtgaataaaaacaacatataccatctggtataaattagtgatatttaatttaaaaagcagagacaatattaatcaataagtaattttcccatctcatgactggattttaattgaaagtatgaattattaccatttcccaaatgtctcattccttattaaaaactttatattattaacccaagtatataaatattaagagcatataattcagtatttacagatgtttaaatttaaataattttaattactatatatgataaatattctaaaattcgtagactcaatgctcttttctgagtctatattttgaggtttttttagggggagaagggcaatatattctaaagtcctttgatacatcagaaaataacttttgcttctaatgccacaattgacatatttcttgctcgactgaaagtatattcccttaagagtcttgtatgtgcttggtttgccttgttattagaacaatgaggttactaaactttggaggaaatggctctaccagtgcatgccaggagacactaccaatcatagtgaaatgtttgcttgcttgtttttaaatgtttgtaacccagtactgttgaagtctgtcttattgaagtactattcattattttccttttctgtcaccactccacgcccactggtctctcggcttcgcaatttcttttctgatgacatccttgaagtagactaagaaaagatgatgtgtaaaaaaggaggaggagcaaattcacttggaaaatatcagttaatagttgaatgcctgcaattccagctagtcgggagatgaaacagaagaatcgcttgaacccgggaggtggaggttgcagtgactccagcctgggcgacagagcaagattttatctccaaagggaaaaaaaaaaaaaaaaaacaaccccgggaacctgaagataatggatgtactgagagacacagactagtctaacatcatttggactgtgtttttcagattttttttcctgagagatttatgctcatttaacaaaaataagagaggcctcggagtcaaaccatattatactcttgacattttgtaggaggcacaaacaataatgatataatgttgaggagtacagatgtctggctggcttcaattttaatttcctttgcctttcaattgcataaccttagacaagtaatcttaagctctcaaagtctcaggtttgtttgtttgctttttgagatggagtctcattctgtcgcccaggctggagtgcaatggggcaatctcggctcactgcaacctccacctcccgggttcaagggattctcctgtctcacgcctggattacaggcatgcaccaccacacctggctaatttttgtattttttagtagagacagtgtttcaccatgttggtcaggctggtctcaaattcctgacctcaagtgatccgcccgcctcggcctttcaaagtgctgggattacaggcatgagcatcacatctggccatgtttccttaaatagaaaacaaggaaataatgtaccacatggggctgaatgtgcattcggtgaaataaagcttttacacagttcctagcacatagtaactattcaacaaaatgaatcttatttttattaatttgactgaaatatttccattaataagcttcttccttgtctcaaattcattcaaggcctttaattaatttgtggaataggaaagtatacttctcactagtataatcaatcagttcacaaatcaaaacgcaaacaggagtacctagttaaatacaatgcaatagatggctctctgtcccaatactttggtctaacaatttatgccttctccagtgcattttggcattgatttgacatgttccaaggaaatccttcatataagcatagattaattgtgtgtgatcctacagtgaagaaacatatctattgtgcttgggttcttttctattttcagtgcaatactgcagaatcatttcactaaaaaaaatagatgtggaataaaatataactgtaccaattccttcatggtagcagggaatcatgaataaaagaagtctaaaaacaaattatgtcatttaaaacatgcaataatgtcttcactttgagcatttttttgttaaacttttaaagatcttttgggacaaagtatatcttatgataaaaagagatatagcctaatcttaactgcttctgtatctttttcttataaatgtaagtaaaactaaataccttttaattgagaacacatttcataaaaatctatcttttcatttatcatctatatctatatactaagtattttctacatctatattcattacctatatgtatataaatttcctcacatatatacatatacccccacacacacaaagaaaaagagatttgcaatgatgtttatctaacccataatatttgtatcatacacacacatatcaagaaagatgtccataatgatgtttatgtaatgttaataatgcttagagctggatggtatgattttgagtttaccttttataactttcttcttcatatattatattgcttatatttctttataatgggaataaaagaacaatatagttatatttttaaaaaatctccttaactccctatttcctctccccaacttcgtgataaaaaaagtcttcatataaatctatattttctagtttaaaaatgaaaaaaattaaattggattcagggcttttcataaaattatagcaaaactcactcagggaagtgttaagtaggaaaattttcatttattcattccttcaacagatgtttattcaatgcctatcctgggccagaagccattccagacacatggaatacatcagtgaacaaaatacaatctttgatgtcaaagaagaatttacattcaaattgaacaagacaagtaacagatcatggattgataaaattggtaaaagtgttcagaataaatatcattgagactttgatatttgagcaaaaactttagggaacaatgtgtgctgtggctattctaggaatgagtgttctaagaaaagagaattgctaactgcttgtataaatgtgctgatgtagtagtgtgtggccagagcagatcacgtggggactttgaggattgtaagagcattgttttttgttctgagtgagataagaatctgttgctggttttgaatactaaagtaatatgatctaccttacatttaaaggaggcacactggttgctgtgttgagactaggctgagtagaatcaggaaaactagttagtaaagaacttaagtacatgaaggttcattaaatgctcagcctactcaataatttagaagaaaagacacaacccaatccatgactattagccatatgaaataaaatataaatatcagagcagatataagcaaaactttgaccaaaaagaaaacacaaaaaatcaagaaacagaaaatttgcttttttggaaaaaacatgatatgaccataaaaacagacacgtacaccaatgaaacagaagagaaaactccaaaataaatccacactcttacagccaatcatttttgaccaagatgtgaagaacatacactggggaaaggacaatttttaatgtatgatgataagaaactggatatccatattcagaaaaataaaaatagattcccatctttttctatgtacaaaaatccactcaaaatggattaaaagcttaaacataagacataaaactgtaaaactactagtagaaaatattgggaagagacttcaggacattggtgtgagcaaagattttgtaagactccaaagaaatataaattttccaatgaaagcaaaaataggcaaatgggattacattaggcagaaaagcttttacacagcaaatgaaacaattgtcaaagagacaacctatagaataagagaaaatatttgcaaactatccaatcaacaagagattaataaccagaatatataaggaactcaacagataaaaaccaaataatccaatttaaaaatgggccaaggatctgaatagacaattctcaaaagaagatatacaaagagtcaataggcatatgaaaaaatgctcgacatcactaatcatcaaggcaatgaaaatcaaaatcacaatgaaatattatctcatcccaactgtaattgctattgtcaaaaaacaaacaaacaaaaaataacaaatgctgtaaggatatggagaaggaggaacatttatacattcttggggggaatgtaaaatagtacagccattatggaaaacagtatggaggttcctcaaaaaactaaaaatagaactataacatgattcagtaatcccactgctaggtatacatccaaaagaaagaaaatcaatatattgaagagttatctgcatgcctatgtttatcacagcactattcacagtagtcaagatatggaatcaaccaaaatgtttatcaacagatgagtggataaagcaaatacagtatatatatacaatcaaatattatttagccataaaaagaacaaaatcctgtcatttgcagaaacatggaagaaactgaaggttattatgtaaagtggaataagccaggcaaagaagaaatatcacatattctcattcatatgtgggagctaaaaaatggatctcatggaggtagagagtagaatggtgcttaccagaggctgagaggggaagaaagatggggataatgataaaatggttaatggatacaaaaatacagatagagaaaataaataagttatagtattcaacagtacggtagggaatttatagttaaaaataatgtgttgtatatttcaaaacagctagataagaagaattgtaatggtcccaatacaaagaaaaatattggagttgatggatattccaattatgctgatttatcagtacacattatatatatatgaatccaaatatcacatatatcccaaaaatatgtacaactaggttatatcaatagtgtatgtgtatacacacacacacacacacacacacacaaacaaaaaaagaattaaaaaatgaatgccaaaaatttccctgaatctgacttcttggtagcaatatacgtatttaaaatgcaaatagtacaatcaagtatgaagcaaaacagtatctgattatgtcgagcattctcaaaacagagaactggctgtgattggtcttctaaaaagtgaaaaatatgttaataaatttggatgataattacaattattgaataaaaattacattttaaggctatattgttccactttactttgaatgctctctaacatactcctgttaatgtctatttaattatgtcacctttaggaaaagttttaaaaacagaaaacttctaaagaaatacgttaatatagctaatacaaacattttatgtaacatatgttagtatagtaccacatactaattaatgtccaatacaaaacagtttatctaaataaccttcttagaataaatgctgaaaggtttatttaactgattttttttcctatgcagatagcattattttaaaatcacaaactaagggtgtcaataaacaattggttcgcttaacttacttattcttgaaccaagttatttttggtagatgctctaaatttcaatttacagcattaccttatccagttacctgtatatacatcttcaattagtttcaactagaaattgcattatgaaaaactgtagtgtaaggtgtttactgatagttttatagctgggacaggtatttactcatggttgatttagctttttatttatttttttacactaaaattattacagcagccataatctcaattacccatttgtctgtgtgaatgagttgagttaaaattaccatgtgatgagaatttctggttttgcatgctcagtttactcccaagaaaagatgggttgggtttttaattaggtttgcctcctaagaggcagtgtaacagaggaaactccatctgctggtggctggtagacgtagattaaaattaaacctccattattgtgtctttgtggaaattacttaacttttcaaagtttcagggaatttatctgtacagtgggaaaagtagtcaaacctacctcaaaggtcctctgtgataggttaaggagactacacccattaaatgcacaaaaatctaaccaatatgaagcgtgtcataaatgttggctacctgttgtgatggttacaagaactcttcagatttcatgattataaaccctacttaggcttttgttgaggtaaatggcttatatttatctagcatcatagagagttccaccccaagtgcttatcaatatttttacacaagcttagctaaattaatcaataggcattgcagctggctggagggataaaaatacaggcatacagttcctactgttctgaacttctttcctccattaatacagacccacagggactctacccagaccatatcctaagtagtgctctagatgccatggagcattttgttcattacattacatggtaacctctctgtggtatcccacaagataaaaatattttcctctaatctggaattagactttgaaagagttcttttgtcccagaagagatatggttttgttaattttgtaactgagtctgttctttttgtttagcttgtttgcttctttcactttggccctaacaaggtgacagtcaagtttgtgactactctatatggactatacaggcctttgcagcatctctgtaattacttactcttactctgatcctttctttaacttctttctcatctgtttgctttatttttctacactcatttttaatgtattttacctttttttctgtgtgaatcattgtaaactacttctgtttttctttggaataaggtagaaaattaaaacaaaattaaatttagcctttaatatttattagacatatatggaagcatctaaaatataatttatgactttctgatacaaacggaattctcttgcataaacattttgtggagtttatgtctcacattaaaaaacagcagtacagactgcggtaaattgtgaataaattgaagaaagtatagaaaagaataataaataggattaagagaacagaggaattgactcttgatgattaaagtggcctctaaaggaagtgatatatctaccttgtaccatgagttggggtgaattacaaaaataacaagctgttcaatttgacaaaacttctaggttataaaaaaaaaaagaggaggaagagaggaaataattttaaaagaaataaatgtccactatgtattttagagatctccataaagcaactgtgattcaaatgttttgataaaataatatataatgatgtccttatttttacactacaactattttctagttattttctacttggtacaagcaaaagatcttaaaaataaactgaactgaatgatatttgaggggagaaaaacagattataatacaagttaagattaaccgctcaatctttctttgcttttcttcctaatttctagatcttaaaataaaaacataaataaagttgtctggaaatgtttttttccttagtgttttataagtgaatttcacttttgaacatgaataaccccttaccttcaaatctcaggaaaaaatatacctgtatcaattattttttctccatcataagttgataagaacattttaaacactttaaaattttgaagcacaattcaaagattcagttaatatacgggtaccttcattacgatgattcattgtgcattaattaattttatttctttaatgtatctttcgatcatgctattttcttaaacaaaatagtttccccaaaattttgtttgtattattttcatagtgcaaataaaggcaacataaacatatttatctttgatttaaaactaaacacatagtgtttttaattgatcttccaataaaatatatttttaatctgggaagatctcatttatctctttttgaaaacaacaatagctcaaagattttaaacttttttcacctaaaagcaaaatgaaaatgtcctcaatgttcatttatttgtttgtttgttttggctttccattgtctccaaaagtttgaatactaaaaaagtaaaaaagataaaaagtagaaagaatattgattctgacaaaatacaccacctaaatgtagcagccctgcctcattctttagtttttaatctttttttttctatgttgctgagaaggcatggagaaagtgtgcaaatatgatttcttttttttatattacatctctcagatggcaagtgttaactaagaaagttgatttattttgtatatgtatatatattttttccaaacagaagctgttataatagactataagcattcagaaatgtgttaatgaatgaatgaatgacgaccattaaaataagaaacatatctatctgaagcaaacatgtcagcatacaggaccctttacggaatcaatatgcaatggaatcttaagaaaaaaagtaaaacctacttgataagtgatttgcttttggttaactttgcttatagaaaaatatgtacaaattggccggacgcggtggctcatgcctgtaatcccagcactttgggaggctgaggcaggcggatcacaaggtcaggagatctagaccattgtggctaacacggtgaaacctcgtctctactaaaaatataaaaaattagccgggcatggtggcgggcacctgtagtcccagcaattcaggaggctgaggcagaatgacatgaacccgggagacggagcttgcagtgagccgagatcgcgccactgcactccagcctgtgcgacagaggaaggctccgtctcaaaaaaaaaaaaaaaaaaaaaaagaaagaaagaaaaatttgtacaaatttggaaaatccaagtcatacaaaataaaaaaaagcttaccttaatatacgtgaaatatattatcagagacaaaacactaattattgtgactttgagccatgtgacagatgattaatccttaaagtaaacaatttactcatattgggctaagataacattcctccaaataataactaagaatccacgtaaaataaaaccttttaactctcaaaaatagaacagaactgaaaatcatggagcaccttagtttataatcatctttgttccatgtgattatttcaatactaaagttttggaaacaattaaaaatcctgccatatttaactaaaaacagaattttaaatctgtgctttttctacatttcaaagagttaagcattaaagatgctactgcaatgtgcacaaggattattataaaatagtagcttttaattgtataattgcatattggggtatcttcagttctgtaaagaactatgatttctttaatcataattaacctaatgagttaaagacaagtcattcttcttgtaaacagaggttacttctctactaaataatgctccaaatgaatatttcaaaaagtagcaaataaattttctttctgtcaaaacaatgaatttccaaggctttgaataaagcttagtcacacttaacctttttttaaagaatagtaaattataccttgaataataaatggtaggatttattattatatttctggtttgtattttatttttatgattgcttttagtttattttatagctattacattcctattacagaaacattattttcaaaaattgtactattaaaatgggtgtgctgcattatctgataaaaattaaatcattcatggcaattctctgttgataatatcttcaactccaactatatctttatgctaagtatgctgagagaaaattggcatgtaatagacaatacagcaatttaattgtagaatatggcagctagggagaagactacataacaaaagaaactcttaaggtatctagtggctaccatattgaacagatgggtctaactaaggactttccatctcacacagaataaaacttgaaatcgtccaagtgatctatcaggtcctagaactgattttctaccatgatatctatattttaataagccaagcatggctctttctctgggttttcataactgcagttctctatcaggaattgtgcctcttcctctctcatagtcaaacgactttttccatcacttaatatagatgtcttctcagatttcaacttatcagaaaggctttctttaaccatcctatttaaaacagcacctctcttccaaaattttctacttgatacttgtatttatctgtctttattacagttatcactacataacttaatattacatatttattaatattgttattttatatgccatttttatgcaatcgaatagaagctccatggcagcagggacttcacactgttcactgataatctccagtgcttacaatctgtaactatttattttttaactaataaatccccagctctaagatacaaatgcaaaaactcaaagagtttgatagactggcccaagacttcctagctagtctttggtggtctgggaaatgagcctaggttctctgaaacaaaaaggagctcaaactttccccttaaaaccaagtttttattacattgatttaagaaaatgtgctagcagttagcgtttcataggtatgcttcccgagagaccttctaattatcctcctagaaatatatatatatatatatatatatatatatatatatatatatatatatatatttacacacacacatatatacatatatactatacaaataaataaattctatatacgtaatatatatcctggctacatttctaatgtaggttttgtaaccttaattctaggaactatagattgattacacagcacatttcaggtgctacataaatatttcataaagttgaggctcttcctcatcaagtcagtaactacttcagtaaagctctactataattgaattttcatattttattcagaaggtaagagatgggtttgagcaactctgagaaataagttgtcagttccgattcatacaaaaatactctaactcagtgtttctaaactcgagtttataattttcaaaatatctcttttatagatgcttaaggatttaaattttagaaccacagattcctcttatttgagtttcatggtgaactgggagtagaaagaagttataaaatgcaaacatttcatagtttcttctttagacaattatttgccaattatttgtccattgtagttacgtgtccctactgttattctcacagctgtttctcctataccttaatttaaaaaaaagtaatttaaaaaaccacaagccttacaaagaggtgaattctaagatcaacttaaaatacgtcagagcacagatattcaagggtatctgtagtggatgcagatcctcactggaatttgttgaatatattaatctaattaaaaaggtatatgtttccttacttaggggaattggtcaattttataagcttaaaatctaaaaagtagtaaaaaattttcagtatagtcatttcagctgattcagtgaggtgaggagtaatcattacagcagctaagatttattacaagcattccattttccaggtactgcggtcttagctatcaaagtgtactgatctttgtaaaatctgctccattgtaaaatggatatgtcaggtcattatttttcctttcatcaagtgtcctcatttgtactgattacatacttaccaaggaaactttatatttttgcctaaaatattggtctaccaaaaaaaaaaatgatcacatgacattccagttttccacttcatcggatagggatgtctcaagggaaatatagaaatggctttgatgataactaacttgtcacctaagaatgtcacagggaattaatgtgtttactggtctcgtcactagaacaataaattcttctatttaattaactatttggcaccccgatggctacctgagttatgtgtgtattttcatcactcatcccagacatggatagggggagcactggggcttcacagtgctgactcaggtcttacagttcttatcactaccacttccatctactaatgtaggtttcaaaaagagatcagaaatatttctgcttaagaaaactctaaatttacataggttttaaaaaaaatctacaaaatgaaatcagacatggaagggacaatttcttaaacaactagtattgaaaaaatggaatatccatatgtaaaaaaaaaaaggctggacccttatcttacaccatatacaaaaattaactcaaaatggattaaagatctaaatataagacctccaaaccataaaatgcctagaataaaacgtatgagaggtgttttgtaacactggatttgacaacgatttattgaatatgacaccaatagcacaggaaacaaaagcaaaaatagacagatggactacctctgactttaaaactttttgcccaattagtgacacaatcatcagggtgaaaaggcaacctatggaataggagaaaatatttgcaaatcttacatctgataagggattagtatctaatatctaaacaactcctacaactaaacaactaaaataaatcaagtaacccaattaaaaatgtgcaaaggacttgaatagacatgttttaaaagatgatatacaatggccaatagcacctgaaaagatgctcatcatcaataaccatcagagaaatcaaatcaaatgacaatgatatatcatctcacacattagtatggctactacgtataaaaaaggaaaaagaaccagaaaataaaaagtgttgataggaggttgagaagttggaaagcttatgcactggtggtgaaattgtaaaatggtgcaactgctatagaaaacaattttctttaaattagaactaccatatgatttagcaatcccacttctgagaatgcactcaaaagaatgaaagcaggatataaaagatatattttaatatttatgttcatagcagtattattcacaatatccaagagggggaaacaacccaaatgtctattgagaggtgaacagatgaacagaatgtggtatgtattgagaactattcagctctataaaggaatgaaattctatcacatgctaagctgtaacatggatgaatcatgggaatatcatgctaagtgaaataatccaatcacaaaatgagaaatactgcaaatttccacttttatgatgtatttaaagtagtaaaatttatacatgtaggaagacaaaaggttgttacccagagtctaggggtaaggctggaatggaaacttgtttaatgggtaccaaatttcagttgtgcaaaatgaagaagttctgaaaatctattttgaaacaatgtcaatatacttaaaactaccaaactgtacacttaaaaatgtttaagatggtaatgtttatactatgttttttaatcacaacaaaaggaatggggcatgtatgtgctgcttaataaactcgcagatttatatttaattcttttaaaatcaacatgagatagaggtctttattccaattttcatgaagaataaaagtggctctaggtgctaagtagcttgtccagaggttacagagctgtaataggatctaaatctctgtgtctgaaaccataatctgcattccattaccaaatgcttaataaataaaatgtacaaaactcctagccactctccacctaagtctactgactttgagctgctagctccatttatatggaatatttaccattcaccgaatagtcatactttctattgtcctagatacattatataattcagttttcaaaataattctatatgttttattagctcttaacagtgaaactgaggttgaaaagattaaattatttgcccaatttcatgttttaaatccaaagttttatgaagtcagagcttccttcacaatgatacgattctctcaagacctgaaagttacctgatttttcctatttatatcatcctatctacttaagaagcattaaaatcttataaattcctgcaaaactatacttttgctattttctttttcagtttgataaattttgtctcaaaataaagaaaatggcatcatgatttgcttgtaaaacatcctttcaataaaatgtatcaagtgtctactatataactggagttatagaaataaaacacaagtctcatacattcgtagagataatattctagtggaaattgactataataataacattagataatgctttgtagaaaaataaactagaataaagggttaaaatttgaagctgggtatcatttcttacataatagacaacggaatcagagaaagcctgtctcaataggcttttattaaagcagctaaaagttaggcacaattctaattatttttaaagtataatcagctattattttgaaaaggctcagtgtatataaactacttctgcagaaataaacaagacactgtacaattgatattccatgcataaatgttgataaccatcaccctcataaaacaatttacatgacaccaaaaggttaaatttgtgaactatcctgaaataattgttatgaatcatatatgcttttcttatgggaaaatcacatatgctttaatccgtgcctactgtattttatttggcatataattactaaaagtttagttatctgactctttaaagcttcttctggcaagctgaagtgatgatattttgctaaagaggcaaattgacagtgacgataattgacctctgtcaaactgaaatcaacagaagacacagaagaacaacctaatgcaggcagagcttaaaacctagacaacgggttgataggtgcagcaaaccaccatggcacatgtatacctatgtaacaagcatgcatgttctgcacatgtatcccggaacttaaaagttaaaaaaaaaggtgatatgtatatatatatatatatgtatgtgtgtgtgtgtaatgaaatagtattcagccataaaaaggaacaaaataatggcatttgccattattggagaccattactctaagtgaagtaactcaggaatgaaaaaacaaacatcatatgttttcactcataagtggaaactaagctatgaggactcaaatgcataaagatgatacaatggagtttggggactcaggggaaagggtgggatggaggtgagggataaagactgtacgttgggtacagtgtacactgcttgtgtgcaccaaaatctcagaattcaccattaaagaattattcatgtaaccaaaaaaagaaaaaaaaatttaaaataatggcagctaaattagggtaattaagggtaaaatagtaaagatattttaaacatcttttacagtatcaaaatataagaactgcagtttaataaataatcacaactagattggagttaactataacatactcagccatggtgagtctacactgttaaggaggcagagggacatgccacatattttacaataatttaaaacatatatattgcttaatattagtcaacttggttttaaaagactaagctctaggcatttagacacattgctttgagaaatgacatatttcctggactggccagactgctttttgagtaaattggagccacaaaatcaaggtatatattcaatccatgaatgttatgatttctcatatgcagcattttgaggttctgatacatcaaagcattctgaataataaaatctcacatctaatttttatccttatttgaagacactctcaaaatcttcacatatttccaattagactttgagaaaacagtaagctaaattattattaaaacactcttaaactatatgtttaatctgaacattgtaatgattaaaatgacccactcagattaaaattgtggttgttcaaatactgcatgttattatttataaatgagagtcaacaatgggtacatgcagacataaagaaagaaaataatagacactgagggctccaaaaggagggaggatgggaggggcatgagggctgacaaattagctattggctacagtgctcactatttgggtggttggcacactcgaagcctaaacctcaccaatatgcaatatatccatgtaacacacctgcacatgtatcccctgaatctaaaataaaatttaaaaaatacagttaaaaatcatggtcatataaaaataaatatataaggagacaaaatcaattactctgtaagatcttctatctttttttccactagagtaggaggcacattggaaacaatgacttgcatatccagctgattgaccacggagacctgaaagaagaaaaaacagaattcatttaatttttactcactgaaatttccataatcagaaaacccccacattacctcttccctactatgcatagacacagtggtttctgattttcaaattcaggaacaaatatatatacatttttaattatatgatctacacaaggggttggagactaactggggcagactgagcatgagaaactatttgttgtttacctagaaattaagaatcctgagtgatttcaattgtttttggttatgtgtttgttttattggttatttactgagacatgaagggtggcatttttttttaatttgattgttaaggaacacccaagataatgaaaaatacgttttatattttacaagtcttgagaaatcatttattcattataactaagaatctgagatatgactggttagaataattcattctatgaggtcatcacatatagttttcttgtctatttaaccaactttaaatttgtgtaggtagaggtatatatttagaactttacatatgggttaaatgagctaatttaatggctgttgataactatgtatcattcatttaaaatctactgaatttcttctatgttcttatatttgaaaaatagaagaaaaataaaaatatttattctgtgcttacaacatggcatttcatcttttcctcaatattctacaggtttaactcattgaaatctatcaacagaatcaggttgttattaatatcatttcgattttaaaacaaaaaaaataaattgaggatatatttaataacttaatcctaattaaatgcagtctgccttacaccagagcttgtgctctttactattatccaatactgatataaaaattctaaaaagccatatattatcatgcacatacatttatacactattaaaatataaatgcatttgtaccagaatcataaattgaacactctgagttaggcatatttagcaccgtatctcaatacaatctacagtagggagtaatttcacattgccacacatgtttttataggctccagattctttacatatagagaccccattaggggtcacaaactcaaatgccttcaggaaccaggcaggtaacttaaatgagaaaagtagccaaaagtatgaaatgatagaaagaagtgtaagtaacaaatccaagagcacataactctgctgaagaggtcagctactactcacctctaaggaatattgcagtgtgggaaacaaaatccagatttcctagatatttcagtttttcaggaaaaaaagaaatccaaaatattttgtaaaatgtttgcaactagttagaaatctatcaaaccattgtgtgagcatgatcaatcatgtctgaagactgtattaagacaggagtaggtctgattattacttctgagcaagcagtttatgctggcagttctaaccttgtacccctaacccgtcataggtgtctgggaccaaatgactaaatttcccttcaacatgtaaatgagtcttgattatctttttacaaaacactagctacttcactagcgaactagcgaaagggatcattacagtttttgtatcactttgtcttttcttattggtcttgagttaaagaggatatagaagttgaatagaaatattttttgttttattgtttttgagtttttagcagtaaaattacatgataaaaatttctagaagtatgtatatgaaacttgcataactgttccctccctccctcccctccttccttccttctttcttccttccctctcctcctttttttctttcttttaacattgggccagaaacggttaaaaaaaagttttgataaaaatcaaaccacccggaacaagtagtaactatagggtgttatcccaacgagaagtataatcactaggcctcattctctgttccctgaagctcccatcatctcctctaactgctggactcagaagtactggagtcctggcctcaggacagaggagcttttgcagtgggactagtgctgaagcacttcctaattccaccatctgttgggagaaagctcctggaccatgatgtgggttatggatagggtgagtagtagggaacattagcaggatactggaaaagagaagaaaatgagtaggagaaataactctttattactggttctttcagtggagaattgttaggactgtctgccctgtcaaactgtcctcttctcacatgtctgtctcctggtctggtaagcatgtgcttcaacccaccttttctggctgacagactgttacagatccgtactattagtatcccttgaattttccactgtctcttatttccctacattcatcctgcccaggccttcaaaaatagacccttcattaaactgtcttcaaattatctgactcttgcagcggagacttaaaattaaaaaaaaaaatgtttcacatgtgcatgaattttctgccaggtccttactgatatagatccgaaaaaccatacaatcaggtgtcaggctgtatataccagaaatcggtcacactttacaaatatgatatatgatgtgaacaaaaacaaaagtgggaaaggaactaagtagtaactagtggaggatagattcagcagcctcagaggaagaccaaacataagccttcctatcttagggtagaaacaggatttaatcaaggaaatctcctgctcccgggatggggatctacattatatatacccaacaggatttcagaattggcctggacaattccatatgtctaccattactgtcctcttcaaataggaatttctagtggatattctgtatttttccatcatctatactgggtgaatgtgtttgctggatcactaaaacatcagaagttccctctagacctgataaaaagaacagcatgacatctgagatccaggtgttaactttgataagactttgttctatttgtgtggaaaataatgaaataaatatttggtaatcagaagtatagactggttagctgttcatccagctctttctgtcttcccactgggaacacacagtcgatttctcagccttctttgtagtttagtggagccatatgatggagttctgaccaacgtaaacttagtggaagggaaggaatgaatgttcttaaatttgaaggatagtcactgctttctcttcatcagaaagataggttacttattcaaaatactttaagccaggcgtagtgcctcacacctgtaatcacagcattttgggagactgaggcaggctgatcaattgaggccaagagtttgagagcagcctggccaacatggtgaaaccctgtctctactaaaaatacaaaaaatagccaggcatggtggtgcatgcctgtaattccagctactctggaggttgaggcacgagaattgcttgaacctgggaggcagaggttgcagagagtcaatatcacgccactgcactccagtctgggcgagagactctgtctcaaaaaaaaaaaaaaaaaaaaaagtgagattttgtgcaaaattctgactgaaatagtaggagctaacatttaaggtatctagaatatatccattttaaggttacattttattaacaagattttatgatgttaatacattttgaaaatatacttttatattttattttaaggatataaaaataaaaaacatttaattctgataaattaacagaagtcgcactaccgggagtagttgtcccacacttacctctaaatcattactttaaaatttttaaatctcctgaatgtgctaatgtctggtttatgtagaacacacacattttgactatgcaaatgaagaaataagatattacagtttacatttggtctttgacagaaattctacatcctaactctggtttgttttatcatctataacaaggatatttagctgtttaagattagtagattttatttatgctacttttccagtatagcttctgcaaatatgcaaatatttccagaaatttgcatgtcagtttattacaccaaatatttaataattctctgtgaaattatttaattctgtagcttaataactaatgaaagctttataaatatgtttccatcatcattgagattgatatttgtaatggattcaaattactaggtattgttaaaaagaagagaaataacatttgtgaagcacaaaattaaaaaagcaatggttggaaatttacatgttactatttctatgtcctttccatttattctcataagtttcttttctttcttcctctatactctcataaattttaaatagtgctgtccaatagaaatacaatgtgagccacgaatacaaatcacatatgtaattttaaattttctggcacccacattagaaagataaaaataataagattaattcaataacacatttaacccaatatgtttaatatatgtttagtaaaatatcattttaacatgtaaagaacattttacatatttttatcaaagtctttgaaatctggtgtgtattttatacttatagtacatctccgtgtgacctagccatgttgcaaatattcaatagctacatttggctgatagctagcatattggacaacccaactttagagatattcatcatctcctgcttgaactgtctttcctaactaactaactggtctctgctgcaaactcacattttattaaataaaagaggtgttttaatagtccatttagataattatgtattttcttttttaaatactataccaaaatttagtttccacatgaaatctgaaaccatgttcagttatactacaatctatttgtctgtcttgtactttttttttcttttttgcgatggagttttgctcttgttgcccaggctagaatgcaaatggcgtgatctcagctcacagaaacctctgcctcctgggttcaagcaattctcctgcctcattctcccgagtatctgggattacaggtgcccatcaccacacctggctaattttgaatttttaatagagacgaggtttcaccatgttggccaggctggtcttgaactggtgacttcaggtgatttgcctgcctgagcctcccaaagtgctgggattacaggctgagccaacacacccggccattgtactttgaattgattttttacacgtgcataattttttaacatcctgcattggccacttggaaaatacaagtttactgaacactgcagatattgtaaatatcaacacacttcattacacaatatcaataaataaatcacattatttaatacaaccactgactcatcaagaaagtctaaatattcggaagctagtcaagtttacagtgacaggtacatttttttaatattctaatttgtgcttcaaagcttcagtattatcattagttggttgttttcaatgaaatgacaggctcccttcatccattttgtgtaaatgcctaccaaatatttaagtttgaataaccatattttgtctctaagttgctctttcatataaaaatgttagtccataaaaaaagcagcttgttcagcttgcatagtgcttttccttgaggcaaccatcttccacatacagcagatgtactctatgcatacttctcatttcatcaacaaaataatgaaaaggtgtttaggacactttcgttgataggttagctagctgcctagatagatatacagtatttactaagggaatgaatgtgaggtttaggagagaaaggagtcaagaaattttttgcctaaggaactcaaagtgatttggtcatcaaataaaatgaggaagactacaggtggaagaaatgtgatgaagaagagaaatccattaggaaacactaaataaacaccttttaaaaatattcgggtggaattgctacatgtacagataaatatgcaaatctggtgttcaggaatgatctttagtgtaaagatgtaagtatgagcgcttttactatgtagatgatattttaaagttatgggactaagtgagcttaacaagtcagtgagtgcagatagaaaagagatttaatgtctgagccctgagaaacctcaatactacaaggtcaggagaagaaaatgaaccagtgaaggagactgagaaggagtaaacagtgagatagtaggacaagggagtatggtgggtggtctgaaagcatagtgagggtaatagtcaagcattgctgatggttcaagtaagataaggactggcatcatcagtacatttcctaacatggaagtcattggtagcatcgacaagaatagtttggaagagtgtttggagagaaaacactcttatgattagagggtttaagagagggtttaagagagggttcaatagtgagaaataagtcaaatctaacatagaattttgctaaaaagaagaatagaaaaatggatggcagctagaaggtgatatagatcaagggatgttttataatttttggaagatagaaaaaaagcattgttgtgagaataatctgatataaggaggaaatttatattaataatgtagaaaagaaatgggagagctgctgaggcaatctcctagagctggcgagtgggaattgaatctactgcataagtagaggtacaggctttagataaaaacagaattcatctaaaggagccagaaagaaggcaaagaatgttggtctagatcctggagggtaggtaaatttagtggcaggagtcatagaagtgtccttctaaatgctttagtattatttttctgtgaaatagcatgccagttaatcaggccatagtgagaatgaggacaaggtattggagattcaggagcagagaagattttctaggacatcgaggcaaaatagagtgattactgaccaaagcaaaagctcatttggagggtttgttttagtcattaatttaaattgatactgatgcaggagaacagggtctggaggcagggaacctaaggccaatttgtgctgacttcctaaagctaaatcaaagggaaaacaccaaggtctggggtcagggaatctaaggccaattcatgatagttttctaatggtggattaaacaggaaactcctgggtctgggggcagggaacataaaccaattaatgccaacttcctaaagctaaacaaacaaacaaacaaaaataccatctccccacaccccacctgagtaacaaaggatcaaaggctactctccctaaaaccttcccccttcccccatgtctcagatggaaagggaaagtgccttggagtggctgtgggccaagcaggggccatcctttcatttgcttagggcatcaatccactcaggccttgggtcaattcagctcagcctttagcctcaggccaaatccttcatccagataaggggtagcccacagggacctcaaaaggagtattaaaacccagaaaactttgtaaccaggcccttgagtcacttgcttgagtccactcccaacttgtggagagctttcttgctttaataaatccctgctttccgaggttgcagtgttgcagtgagccaggatcgcaccactgcactccagcctgggagtcagagggagagtccgtctcaaaaataataataataaaataataaataaataaataaataaatgcccactttccttgctttgttcctttgtttcgttcctgtgttaatttgtgtgttttgttcaattctttgttcaaaacaccaacgacatggacaattcacactcaaagccgtcatgtaacaatactatagctaggcatggtggtgagtgcttgcagtcctaggtgctagggtggctgaggtgggaggattgcttgagcccaggattttgaggttgcaataagctttgattacaccactgcactttgacctgggtgatagaaccagaccttgtttcttagcaacaacaacaacgatactaattatagaattttgtatgtttttgcagacataatcagcatggatataggtctggagaaaggagacagttggaattaaccaaagtggaggttttgctaagtgaatatgacatagagaaagaaagcaagaaagttaaattttatatgatgtactgcttattataattggtaatgcattataaatccagtaaacaagaaagagaacatgagaggttctcatgagagaacacaatggaagttaaaattattcggctaattggactggacatcctggtaggaacaaaagaatgatgggtttagctgcaatgttaattaaatgttatggacaaagagtgggaggtttgaaatggaggttataaaggtaatggcaaggtaagccaagaacagaaagttaaacaccacatgttcttattcatatgtggaatctaataaaaagtgtttaccgatcttaatttgatcaaaaatttatgtcaaacttaatatctcctatgtcaaaagcttcttggcttagagtggccttcatttactctattgcagctttactgttaaaaatgagaatgctcctggaggactgttttggccacaatcatggtgattgttcttcaccattatctaagaagaaaaataaagcattgatgtctgcatgtatatgaaggttacgcttgtccagggaactaaatgagaagaactgcgaaaaaatgaaaatttatgatgtaaagaacaaaagacaacttattcttgatctgtttttatgtgacaaatatttctaatgaatatactttgtattagattcatcagacaaaactccaaataacccatgctttcaagttggtaaagagtccacaggatatatgcactggtgttaaatattttcaatacaagctaatatcaaacttccctttcaaatgatctatcactaaacttctgcactgcctaagtgaaaattagaacagtgatattattgactatagccaaatataacttagtcaaggctaaacaatgtcatcattgggaattttgatagaacaaagaaataaatactattggaacaaaatttgtccccaaacattttctttgttttctcaattacaaaatgctgaaagtaatttaaacaaataatttcatagtttaatttctatagtataactctgtgaagcatttaaaatttttatgtagcactggacaccctatattaaacatgagctttgaagacaaaatagaaatccagtgcttatacctttgctgttacaatcatattttttcaaatattataatgtttttctcaaaggtcaagaaaaataaacaccttacggtgtttttgtaaatatatatatatatatatatatgaacaatatatttacatattcctaaactatagtgactaacaatctgagtgaaaataataattatgtttttgaaaacccgttttaaattaatcttagaagttctataaactgaaaacactgacctatggctagtatcgtagctacttccctttcctgaagttttatctacttacgagtacatcggctttgccgctcagtcccttcccatagtcgtcagttgcaataacttgaaacttgaagtaggatctcctcatattatggaagagcatagcagttttgataagccctgtatatgtttccactacaaatccttcttttccctctttaattggtggtattatgagtctgtaggccatgacactataattgccagtatctttatcagtagcctagacggaggggaaaaaaaaagagattataattaagcaggaaaagataacccttatgaaatggcttacttttgtttgtaagaatgaggtttcttatgtaataataacacaataaagccctcctaaatgtctgttttttctggatatagttatgtagattaatagactttgtgtccacagtttcgaatggttgctattagaatgataataactgctgaagtatgaataaaagggacataggtataattctgtaccctttaacaaatttctccctacccctcctttccttttacccttaccagcctccagtatcttgtattctacactttatttttatgagatcaccttttttttagattccacatatgaataagaacatgtatgtggcatttaactttctgttcctggcttatttcatgtaacataatgtcctagatagggagaatatgttctagtgctctataccactgtagaataactacagttaacaatagtatatagttccaaatagctagaagaaggatatcgaattttcccaacacaaagaagtgataactgtttgagatgacagatatgctaattaccctgatttgattgctatgcattatacatatagaaacatctatgtacccaataagtaagtactattattatttgtcaattttaaaaatagattttaaaaaataaacagacatagacactaacagagtcaatgaatcaagacttttggtttacaggtttgttgagttcaactgtgtgtgctgatccaaattggttgaaagatgggattggttgtttacctaatgtttgtcttgctgtaataggcatacagtgtgatggtatttttgatgtagtatatagcctaaggaggataaatataaaagaacgtagtaaaatatctcgaatgaaataaaataaagttgagttataacaaatttagagatgcataaaaatattctaattaattaatgccataacataattctctaattagagttagaatactatccgacttcctttttaatcatcctgtatcccgattaaacatatttgttcctggtgataggtacttatgatccacatattaaagtttcctaccatttagaattaaaaaggactaacacattgtttagatttttttcatttgtttttaaatacagctatgagaatcatatattgggctggctttatggtgtctaattaggggtaattttttagaatgtctatttcagaaccatttcatagtgaaatacttggaaaataaatggtagataggagagttttagaggcttgataaaagactatatataccttattcatgatactagatatgtaagttatacattttcatttgttataacaatgattattatttttattatccgattattcttatttttacctatgctattattattaagtatgagtatgcatttatgatctgccattactaagaattgctaagaatcatacaaaatacaaaatacaatcacacaaaataacatcatacaaaaatagtcttatctaataacaatataaaaaactgaggaatatattgttttacttatataaattagtgatattcaataaaattttctgaaatgatagaaatgttcttaaccagctctgtcttatgcagtaggtactagccaaatatgacaaatgaaaagtggttgatgtgacaaagaaactgaaatttcaattcaatctaattttaatttaagttacataatgaaagactacataataagtagtaaagttgagacacaaatgattaaaatagtaaatcatagcaaatgtgtattaaatacagcatcaacttgatttagcttcaaattctatatatattgtgaaccatttaaaacgtttccagataatcatatctacttgttagaaaaggtaatttaaactactcaacacagataatttcacttcaggatcagctgtttcatgaattttctagggagttaatattctcttttctttatttttttctctgtcacccaggctggagtgccatggcataaactcggctcactgaaccttagtctcccaggttcaagctagcctcacatgtcagcctctgagtagctgggactataggcactccactacgcctggctaattctttgtagacacagggtctcgctatgttgcctgggctggtctcgaactccttgactgaagcaatcctcccatcttggcctaccaaagtgctgggattacagacatgagccactgtgccaaacctaaaattatctttagaagaggacaagctcaaactaccggctaatcactttagatagtttatatggcttacagcatggcagagctcagttttggtattagagtaatagtaattagttatcaatgttaggtcacattctcacttaaaggaaaaagaaaatgaacaaagaaagaaaaacagtatcaaaattttttgtacttaaactttgaaccacaggtttataatcactcaacaaaggatagcataagatagaaaaaggcatattcccagctaaaataagtcaaagtctgagtcaaggtatccaagacatttcttccacatagaatgagcaaatttgggcctaatgtcagatcagtcagatttggttacatattattctctatcttcttattaacatggatatttctatgaaacaaactttttattattaatgtaaactttataaaggaataacaaacatgcaaaaagtgtacaaattataaatgtaaagctcattaaaattttgcaaaatacacacatctacatgaccagcatttacatcaagaaacaaaacaagccaggcatggtgactcatgcctgtaataccaacactttgggaggctaaggctggaggatcacctgagcccaggagcttgaaaccagcctgcacaatatagtgaaactcttatctcttgaaaaaaaaaaattacccatattccagaatgcacttcatgcacttggagtcacaatctgagaccttcttaaggaaaaccactttcctaatctaacattgttgattagttatgcctatttttaaaactttacattgactgaatcataaaatatgttctattttctgtctgacttctttcattcaattttgcactgtaagattctaagcccttatatttaaaataaatactgtataacaacactatcacatttggaaaagaaaaggtggttaccataaaatcaccacagtgattgcttggtatattaagctactttacacagttctgactgattaacttccaatttcagtaagcaggtaatttcactttgcaatattcctaatatattaaattatgataactacaaaatagtcatattccatcttaaaatattaaagtgttctgttaaatgtgcctttcctgaaacaaattatcacttaatgcaaaagtttgggtgtggaactagacaatttaactcagaaataactattttcttttatgatttttcatataaatgccttaatatttgcagaaaatagtcaagaatgagataaaagtttttttaaaaatcttgtctactggaattaaaaaaaataaaaccctattgtcatatgtatgttatacagtaaggactctaatttttatttctttgaatgaatatgatagtctttgggatcttagagatcttatttcaggagatattcatcaaagatgattgccaggatcattagcatatttttcaaatctcccctcttcctcaagtatgttcagttgaatactagtaatttaaacagtgactgatgaaaattccaatgggtgccatacttaagagcaattgcatggatttttaatttttagtctccccaatttataacaaatacatattttaaaatccgaaacctctcctctaagatgtgactctgattgatgtggagcatatgcaataccatcatacatagataacaaccaaatgttctttctataaaatcaataacaggatacgatatctttaaatacacactgagtcacaccagagataccaataataaaattcagagcgcagttttaaatctgggtcaatatgtgaaaaataagtgagagtttcagcacagagtatattgtctctatttgttgttaaataattttaaacttacttttttgcttgttttttgcattatgttttggagtgaggtggactccaatgtcaggtgtgactttgaaaaattaataactcaaggccgggcgcggtggctcacacctgtaatctcagcactttaggaggctgaggcgggcgggtcacaaggtcaggagatggagaccatcctggctaacgcagtgaaaccccgtctctactaaaaattaaaaaaaaaaaaaaattagctgggcgtcgtggcaggcacctgtagtcccagctactcgggaggctaaggcaggagaatggtatgaacccgggaggcggagcttgcagtgagccaagatcgcgccacagcactccagcctgggtgacagagcgagacgtcgtctcaaaaaaacaaaacaacaaaactaataactcaaaatttcagatttctttattcataagataaaaataaggatgcccaaaaatagtattttaaaattttatatatattcatacgtgtgtgtgtgtgtgtgtgtgtgtgtgtgtatatacacaaaaatataaatatgaccaagtccagtgtaactattatagttacctaagttgtcataatggtgattcaaaaggtttaacattttttcatattatgtttatccatgaatatgtaaatttatgcaatcaatttagacccttattacttcagacatattatcacacaattgtaactcccttataactctacttttcttaattttcttttccagctctcctttattgcttccagttcttgttttgttttgttttgttttgttttgttttgttttgttttgtttttgagatggagtttcactcttgttgcccaggctggagtgcaatggctcgatcttggctcaccgcaacctccacctccctggttcaagcaattctcctgccttagcctccccagcagctgggattacaggcactttgggaggctgaggcgggcggatcacctgaggtcacaagttcgagaccagcctgaccaatatggagaaaccccgtctctactaaaaatataaaattagccaggcatggcttccccctcatttttgaagcaattttgcaaaacctcttcctcagttgaaatccatgaacttttgtacagtacacactctacccctccttgttgccaaacataatgaggatgttggtatcttgctctcagtctaccccttctacttcaacttcctccctctttacaaatttcagtattcattgagatgacacatccagcaacttatttttaaagtattaggcatgaataacattcatcagtctttgaacgacctcactgcatcgatttaattctacagtcacactttagtcttttgccttagggagatattccgcttaaagaaacactccatatttaatttatatattaaactttcatgtctaaattctgaccacaactttaatcatcatacttagttaagacctcttctttgatatcagtgaattttcagttctgcaaactgccttttgctcccattacttcagggtttatgtccctttctgctttatcatagaagtcagagttgatcacattgttctcatttctctctccttccacaacacctggatctttctcctcttggaccaaactaaccatcagtttactcctggtgactgaagagggcgcagagaaattaaataatcagtcagactagtgttactgtaagtccatggtctctgagtttcactgtgcctttgtctatttaggaaatccttgctatatgtaataagttctctttctcactccagaagtttgcctttttctttagttcacagattctttcagtcttctccagagataaggaagctctaattcccataaaatttgaggatatcaaatgtgagatctctcagcttttcatcacataactaaaaaagtacctatatctgtacttactttgactactttcttcaaatctcagaggagcagctgacacgtatctctcactgaaggtacttatgccttaatctgaatcactcccatcccttctgcatttaatgcttcatcagctctattgatctctgtccttttcacctctcctctacagactataaaacacgttatgtctctctcattaaaatgaaatgaaacttttcttttactgagtccacactcgtgacactagcccccaaacttccatacctatttttcacagttaagttcctcagaaaatttttatagaatcaccatctgtaattccttactttacaatcatgccttaaccgcagccagatctctgcccctgccatgccatttaatttgctaacatcagtgactgaggctggactccatctcagatcaacaatcagtctggtgttctttaaattaccaagtccatttatgttgtttgtataatgctgttgctgcttccgctgtttgctaacatttattgaacacttacaatttgccagatgctatgtaaatacatatattattacattatctcatgacatcctttccattgagtagattccattattattttataggccaagaaatggaggcacagagagattagtaacttgttcataatcacacatatggttgttagcacagtgggataagtctcactttaaagccactacattccacatgtgagactaaataccagggataaaactgcagtttaaaaataaaacaacaaatgttcgataaaatattctaagaaatcttcctagatccatcaagaagatggaaagacaataaatatgccagtcaaaaacaaagtgctatggactgattatttctccccaaatttatatgttgaaacataatactcaatgtgatgtcatttgaaggatgggcctttgcaaagcagttaagttcatgatggcagagcccccatgaaacggattggttcctttttgaaaagaggccccagagacttcctttgttccgttttgccatgagaggacacactagaaacgcagccatccatgaaccaggacggcctcgctaggcacttaatctattagcaccttgatcttgggcttccctgcctccagaactatgaggaaaaataaatttgtcttgtatataagcttccaagtctatggtattctgctatagaagtctgaatgcaaaagtaaaggtaagaatataaaaaccatagtactgatgggagctttcatttagaatttttttgttttttttactgacctgggtaaaattaaaatttaacttgtctggttttcagtagctcagacaataggaggcaaggccccaagcctactcatgaaagtgagtctattaagatttccctccccagaaagttaaattctcaccgtaagagtaaaggagaaatttacttttccccctgctaccactgctactatcaccccaaactgcaacgaaaactgtaaacttaaactttgctattgaggggagtgaagagaaaacttctttgagaatctaggacgaaatacagcccctcattttagtttgcagccattatttgccggccaccagtttgcccaactcaaggagaaatcataatattccattggtaaagtctaataggcctgatctccacctgaatggacagaaaaaccacaacctgagaatttaagagaaatcatctatgactgaaaatggcctggtctcctgcctgacagaagcaggtgctttttcaaaaacccctcctgcaagccatgcctaaaataattctaacaaataaagttccaagaaagatgaaaagttataataattatcaaaacaaacaagaaacaatcataaaaaagtccgttgagataaaaaaatcaaattcataacaacatagactttaaatatttgaattagtagacactgaatataaagcaaatatggttaatacatttcaataataaagagctttaaaatgcggaataaaaaatgagactcgttgaaaagaaatgaaaaagtatcttttagaaataaaaaaaaattagaattaaataccccaagatgggattgttagcaggttaagcgcagctgaccagggaattagtaaatgaaatgatagggcaaaggaaatgacacagaatgtttcacagagctacgaagatgaacaacctcaaaaaaaaaaagtttgagatatggagtttagaatgaaaattttggcaaatatctaatcagagtttcagaaagagagaaagcgagaatagaacagaattttccagaactgataaaagattgttatccacagatattaagaagcccaataaactgcaaacaggataaataacaagtaactcacacctagaacccacatgtcatatagaaactacagaaccacgtactgtaaatataataagtattgttttcttaatattttgggaaaattcatagagatattttagtaatggcataaataattcataaatatattctataatttattaatagtaataaggagatgtctaacaagttgggttaaattaatgcataaaaattaaaactgactcactgtggaaacgctaaatgaatacaatttactaaagaattaatatgatattactttttccaccaatttctctataatcaaacatttatgctcagttcacaacaaagtcattaatatctgggagaggtgactctggaagatttgattcactgacttttatgagtttcccttagtgaacaaaataaaaaaaaaagttagtctagagttcttttaaaagaataaaagtcagaaatgaatattataattatacttgctataattatattttaagtgaaagcttagatacaggaaaccacttacccatttctaagacctcatctggaaattttaatggatacagatgtacaacattaaaagaaaatcaccaaataattgcctctatcatacaggggagtaggggagaccattaattttctaatagcctaaataactgttcccctctgttgcctaaatgaataccatggatgcagaaatattagtgaaataattagtgatgtcctaagaactttcaaacccattaaagttcagtaatgccaagtttaactttagcttctcaattagacccattttaacatttaacggtattgaaggctcacttaccctgaaatagagtgaaagtgttttagactgtctggataaaaatactcaaatctcacatttccacctaccaaggtcactatgtcaagtttgcaaaaagcaaaaataacagagctttggcaggttagaaccactttaacttgagtcttgtttttttttttgtttttttgttttttttttgacacagtcttgctctgtcaccaggatggagtgcagtggcatgatctcagctcactgcaacctccgcctcacgggttcaagcgattcccctgcctcagccacctgagtagctgggactacgggcacccaccaccagatccggctaattttttgtattttaggagagacgaagtttcgccatgttggccacgatggtcttgatctcctgacctcgtgatccacccggctcggcctcccaaagtgctgggattacaggcatgagccaccgcgcccggccaactcttgtatttttagaaaccagaaagaaatctttattttaaagtccttaaagacaatatacccagaacatgataaaatatgaataagaaaaatgtcaggtagattgatctacttttagggctattcaaaacttttgcaaaaaaaaaaaagaagaaacaaggagagaaagagaaaagaaacattttaaatatgcaagctcaagtgtttgattttgcataagaatgtcaaacagtgactacaatgcaatattaataatttctaagttcaacatacctatttactttttgtagagttaagtaaaagtctaatataattctgagagattctaaagagtaaaatacaactcattgtagaaacagcaatgtaataatggaaacacgccagtgcaacaataatagagacatgccatcatagtttgaattacaaagacctttacagggctgggtttcggttagaatttatcaaaatttactcttaatttaaatcatggtgcaaaaaattacaggataacatctatttagaaaattaaagaaagaaactaaagaaaagccaaatgttccttttattattttaaaaaattatatggtaaattctgaaccatagaaggcttgagagtacaaaacaagcaggacttgcatgtatgttataattgaagtttccttttttattttttcctttcttttaaaaatgttttgtaaaataaatattaccctataaatggttttgctttttccgtcattattgctaataataaaatgattatacctccctcagagatgctttaaaataaactctgagctaattgttctaacttttcaaccatgtgaaaaagaaaaaaattgtgctctattatatagacaagttaacaaaagaaaacacacatgtaatttatgctttttacttgagaggaaacactagtttaaatgttggtttggttttgaatcacaaaatgctattaatttttaccgaaaatatccactcttaaacagcttatcttttacaataattctgtagttatacatcctaaatccttcagcattcaaagcaaattaaataacatacttgttatttttgaacttcctgatttttccttagttacattaggttcaatcagtccaaaccaaattcagctgctgcttcttggctcccaccttgctgtccctcttctgactatcatatgtggttctccttctgttttttctttttgcataggaagggcaacaccatctatgaactgaactgttctaaaaaatttcagcatcctccccctcggtttaatctcacctcctggctcctccctacttccagtccatcagcaagcattctgatttctacctatacaatatttctcagttctgtataatactttaggccaagcttacactggccaatttcaggctctcatcagatctcacttttaactctagcgatagcttaaaaattactgatagctcccacttgccagagatgaatgttaaaacaagtcctttaaatattctcaatctgattaaagttcatgattccaactttttgctttacatttattctacttcccagaaccatattattttgtttttctgaagaatgtgttctttcaggtttctatttctttgtatacattgtttcttctaccttaaatgaaatgtcttttgtctgctaggccaaatgatgttcacttcttggctatactatggcacacacacacacacacacacacacacactttgaatatatatatatatatatatatatatattctacatatacatacagtaaactatggcatacacacacacactttgaatatatatatagactatatatattctatatatatagtctatatagtctatatataatagactatatatactcatataatatattctatatatagtctatatatatactatactatggcgtacacacacgttgaatatatatatatatctccatatatataaaatgtgtgtgtatgccatagtatagtatatatataaatatataatatattatatatatacgtgtgtgtgtgtatatatatatatataataaaacactgaataaagcaatcaaacctcagcttaaatgaccccttttctgaaggtgttcttatctctactagggagtgctgcttctacttacatattttcattgttatgttacataaatgtgtgtgtatatattagcatttattatgacacgttttaattttgtgtgtccattatacgtcaaatttgtttcagttcatatttttcactgtggtaccacgtgcagtcagtggtcaaataatatttggcttaaatgtctatagaagactatcatagtggttgagacatcaataattagaattgaaagatttgagtttagttctaccacttattagatacatgagcttgggcaagtgattctctaaggctttgctcctcatttgtaaaatgaggaaaataggacatgctgaataagttggctgtgaatattcactcgggtgtaaaatgcagtgcctggtacaaagtaaacctaaatcaaggttagctgttgttttactattgcatttactactgagatctttgaatactttgtagctatcttcctgatctcttctatttgttctttttttttttaaatcactttttgtacacttaaacgtacctttcactttctgcatcgtgtcactggctataaattctttggaagcaggaccattttctgaatcgtctttggatctcataagtctcatggccagtagaatgtaattagaaaatatttgctaaagaataaatctgccactgaggaaagtatagttattgatgtctctttactgaatgctatataatttattgatagcaaagcaaaagcacttaaatagaaaatatttataatgatacagatataataagatgcttataaggagggtgggagccaagaagcagtagctgaatttggtttggattaatgaagactaatgtaactaaggaataatatagaagtttggaagtttgaaataacaagcatgttatttaatttgatttgaatgctgaaggatttacgatgtatacctacagaattattgtaaaaggtataccattcataaataatttaagtataggcatttttggtaaaaattaatagcattttgtgattcaaaaccaacattcaaactaatttttttctctcaaatagaaagatcaaattatacatgtgttttcttttgttaatatgtctatgtgcctcagcctctcgagtaccagggactacaggcgcgcaccaccacgcctggctaatttttgtatttttagtagagacaaggttttgccatgttggccaggctggtctttaactcctggcctcatgtggttttgccatgttggccaggctggtctttaactcctggcctcatgtgttccgcctgccttggcctcccaaagtgctggtatcacaggcttgagccatcgcggctagccgtaactttatattctatacttaaaatttgcttcatgataagctgataaatcctgtttgtaatttctgcattttgtatttgtactttttcattcattttaaatcttcttcatgtaaaacaaatattttgtactccaatgcagtgttcaatattaacttgtaatttctgaaaattttactgagaaaccactggaatatttagaaattcaaataaaataggtgttatgcatattacatataatgaagacttcacagttcataataaacatctattttaaaattacatggccacagattcaacccatgggcccaaaatttgcaacagagcaggaagacttgtattttaatatgctaacagtacaagtcatttgacctagagataaaacaatttaatattttaagaacacagggttcacgaagcaaacttgaacttactgtaaaatgaacttactgtaacatgatttcaaatatgaatagtgtataagaagtctattcatcttttaatttctaaatttaatggaaagtcaaaggaaagtaatagcagggcaattgaaaattaaatctgaatgtcgaatcctctgtaaattctgacaattttactgcctacctaataaatttacaaacagaaacaaaaagctctattacaaaaatttttaaaaaaacctttcttattgctttcatagtaaaagagtatgtcgaggcaaatataattcaatttataaatgttttaccttggaaaataaatttataattttcaaaatagactggatatatagggctatgatgaaagtaattattaccaaacaaaatgcctttagtattgttataatgacactaattgtaaagaagactgtatttatggactagaatggtactatttgtacatgggacaataagatctgtctcctcgaatttatataattgtaacatgttaatataaacaaccctcaaaaaaacagtgtctgtcctcagtgtccttcatttaaattgatggtattttggagctctccctcgtgctctctctctctctgtatgtgtatgtgtgtgtgtttaaaaacacacatatgtatatatcacatatgtatacacatgcacacatatatagttatttttatattttataacatgatgtattttgtgtcatgagtaccaacttacaagtttgctaaaaagaaatggctccaacaccagtaaaatttcagtgaaatagtcttgctgcatgcagctatactacctaaaatttcaggatttgttagccagactcaaatactgcatgttcttacttatacgtgggagctaaataatgtgtacacctggacatagagagtggaataacagtcactggagactcagaaaggtgggagggtgggagagggtgaaggatgagaaattacctaatgggtacactattagggcgatggttacagtaaaattgggaatttaccactacacaatacatccatataacaaatccacttgtaacccctaaatgtataaaaataaaaaaagtaaaaataatcattgataaaattttcttagcttaggcagcagaaagtaattgagcatgaccaaaaacgtttatgccaatagagcaaagagaaaaactgagtacacataataaaatttatcttttgaagttcacacctggactaaattattagacatacataatttttaatcattgaaaaaaaccaagccaccatgtatttatattcttaagaataatatttctaaaatgtgtatgctagattacttttgtctacataaaattatacatatttttaacccttgcgatgttttgatgtgaattgtggttcacaaaatatactgggaactaagtaaaaaaattacaacaggtaaatgacacagatctgatcaggactgagatgaaatattgtggaagcatccatggtcagagattgcagtgatttttatctgaagagttggccccaaaacaatttactatacaggatgattaacattacaattccattttgagataatttggtaaaatgttaatattatgaattgcccacttgcttttttttttttttttttaacatggagtttgtttctgttgcccaggctagagtgcaatggcacaacctcagctcactgcaacctccgccttctgagttgaagcaattctcctctgttgggagaaaagctgagtgttgggagaaaagctgagtgttggcagagaagctgaggcagggcttgcatgtctgtgagacttgctggctccttgcttctagcactccccttatctcaagcagacatatgtttctcattcacttgatacactgtttcctttcaacccccacatccacatcaccttttttgtttgtttgggcaccaataaatagcatgggctcccagagctcggggcctttgcagcttccacactcgtgatggccccctagtcccactttctctctcaaatgtctttttctcattcctttgactctgctggacttcgtcgcccccactacctggtgttgggtctgatcaccccaacattcctgcctcagcctctcaaatagctaggattacaggcacgcgccaccacgcatggctaatttttgtatttttagtggagatgggggtttcatcatgttggccagtctggtctcgaactcctgacctcaagtgatctgcccacctcagcctcccaaagtgctgggattacaggtgtgagccaccgtgcctgaccccaactgctattttttaaaaatatggttatttttcatgaaccactgatggaattgtaatacacgcatatctctttgcaaagttattagaatgtatttgtttttccctctgtttttcttttaaaatattcccaaatcatttacatctaattattaatgttctgtattatgtgtaaagatgaaaaattgtaaaaatgtaaatggccaatagtcttttataatgtgtttaatatataaaatgctttgtgcttcttgctttttagaaaaataccattaaatgcaaatggaccaaggaatacaaaaactttataattttatccatttacaggcatcattaacacattggtgtttgttcctttatgtttttttgatgtacatatgtatatacatatatgtacatacacacatatacatataggatattatgatcctagtttactgaaagaatacacatatgtatacatataaaaatacataagaatacacacacatatatacacacatatgcatacacatacatatgtgtgtgtattctatgtattcatatatgtatatgtgtgtgtgtattcttccagcaaactaggatcatgccatcctatagctttgtaatccatttttttgtcattagccagccattaagaatttttttgttttaaccattttctattttaaacatcatacaacagaaagagtaggataaaaatatcataatgatcaggtaaaattatttaaagagatatatttttttctttgcatcatcatctcctttttctcttttcttattcgttaaatctttgtttttacaaatccctgtgctaagggctgatactcggtagactgcagggaggaaactgctctgccacttaaaaaacactgaccaagaagcaggtcatctacactagttcctcacaaatgtcctttgtatggcaggaaggaagatatgtatgtttttaagtgaatacatacacatctataaattgttgtaaaataacccccagagaacaccaacattaccaaagcttgaaagatagtttctaaataacattcacatttaaaaggcttttgttttgtttgagatggagtctcactctcttgcccaggctggagcgcaatggtgtgatcttggctcaccaccacctccgcctcccaggttcaagcgattctcctgcctcagcctcccgagtagctgggattacaggtgtgtgtcactgcacccggctaatttttgtatttttagtagagacgggctttcaccatgttggccaggctggtcttgaactcctgacctcaggtgatctgccctcctcggcatcccaaagttctgggattacaggcgtgagccactgtgcctggcctgtttttgtaaaaaaacaaaacaaaacaaaacaaaacaaactggtttgtttttatttgatttggccaaaaaatagcactgctcaatctgtctttaacttacttgcctttggccaacttgctctaaaccaaattgttcttcagccaaatctgcaggggctgacactgacaactactggggcgattaaatgcaggttgagttttgtactgaaaaggagtaagagacagaagactatatttgaggaagatctgggaaatgtaagaaatcatctgaaagttgactcagtgccctgctctgttttacaccctttaacaaagagggtatcataaaaatttcttaattctggtagttagaaagaataaaagtcattccgtgggtgccatttctaaaccatggaagattaaattaatgaccccaaatcacacagttggtgagcagaacatatagtctttaactccaagcccccatgcagagttcgccaaaaaactgactgtactgagaaaagtatgtggtgggctgaagattattatcaggttccttggttcagaaacagataatacctgtactgaacagatagctttcattaaaaattacaatctaatatttctcacatttttccctctgtgtagatactgttaagtccagtaggaattagattaagacaagcagctttatctctacacctctttttcaggacaaagcagaagacaaaactggcaggacacagagttgcttgtatccttattagtgatgctacttcattaaatttcatgttgaaagataattcaatgatttaattgcatttaatgctaatcagacccttataaatgtaggtgagatacacattctcattgtattatttttcatttctcattagttacccctaattttcatgatgattactaacataatataccattaatactctcaggaggtggcagaaaagattatgtgtcatgctgtgattcattaatgccagagaaagagctgcttcgtttttcaatattttataggtaattcattctttaataatgaaaaataaattttctgccattcagaactttctatcaatacatttactttgaaaaatggcaatgttgaccatacctatatacaatggggtacttatggtctctctataaacattcttaacttgctggcctttcccaggctgggcttattttttatatagattgtgccccctccttctaaagaaaacttatttaataaatttcactgccttttcccttttttcctactttaattaagagaacttcaagatttatttccacttagcagatgtacattaattagtataatataatttcactccattttatgatatactgtggtataaggaccaaaaaaccttcaatatgccttttaaaaaaaagaaatattattttaaaaactgttctctggataaatttatactgatactgcttgaagactgtttgaagtgtttccagctgtgctgttagggtttgtttctcaggacttcatgcctgtacatatagagataattatttattttttcttaagcttaccatactcccagaaagaaaaatatcaagctacagataaccattgacaacaagaaaattctatgcaaaaatactttataacatggtgctaagataatactactcatttaaaacatataaatatgcctcacacattttaatctggtcagtattcatataagagaaccaactatctcatttaacatatacaaggatttagaaaagttatattgagtattcctcagtggaataatattttcatgtaaataatacactaaggtgtatctcaaagagaactcatctggtgacttaatggaggaatctattatgttgtattcagcttcttataattattccttattctactattaagaagacaaattagcattctatactaatgctgaaggtgaattctggaaagagaggcccagtattcagttttaagggcaaagaaaaatggctgtgtgttcaataaaactgtgtttttaataacatgtatgcactgtgcatgctgtttgaaacattttgattttgagattactatcatcttacagggaaaaagaacaactcaggtaacaggtaacaatgactattgagagatctattgagagaatgtctatttagagaatgtctaagttcagagagaggaacgaaccgtgctcagtgctttatgtgcattttctcatttatattcagataaaattcattagctagtgttgtcatcactctgcagacctgttgcttacagaaattaagaaacctgtccactcctggttacacagcccactcatggttaaataaaacctcacatttgtccttattatgcttttggaaaacggttagacttaaatatatcaaaactttatttttataatgtcctttatatattatattcattaacctttctttcacagtcttccgatttagcatacccataacatttggttaaactttaatcaacattgacttaaataaaatgttcttgtagtaattcctatcatgacttcatgtttttggggcaggagctgctagtcgtttcctgcccacatgtatgcctcttttttttttttttttttttttttttggcacctttgggctcagccgcatcttacactcatatcttagctctgaaccagaatattgagcccaaaaagagcccattcctcaaaagaggttgtttcagtatcaactggtcttgttctattcaaatgttacttaatctcaaagtgaatatgttcagagctcactgccttctgggtctggaagccacactgtttactttttcctatgatgtttgttctctgctgagtgtcgaaatccctccaactgccttttctaagatgcaggctgttccctttcacttatttttattgcccattttgggctctttatcaacgccctatattataaaacatcagcaaggactgtgtctgtgcttacgtttttgaaggatttatgaatctgtttttgacatgttggcatgattatgcaattttttcaggtccaaatgatactatactagctcatgatcctggattctgaaaccaagaaccaaagtaaacacatatgctagttcatactgactttcattctccctaccaccctgtctttcagatccaacctaaggtatttgattactggcacctctcagctactaccacctgtaatatagtatttcgtcttcctaaaacatgcattcttgctataaatgacaagaacactatgtggcattgttttaccaagcattaaatatcgagaattccttaacattaagtaaagagaagactaatatttagatggaataaactatgctaaccaataagaaaaatactagcttatccccttttgtcagaattattttatcttccatgaagaataacttaaaattaacagaaagttgaataatctttttccttttccttttaatttcaagcttgttaaacatttttagaaatgtaatatacatttctaaaattgtgtctctacagcttcacgtttcttctttgtttctacagtactctcatgaaaattcaattctcttccctgtatttttaaaaactcattaaacaggtcgggcacggtggctcacgcctgtaatcccagcactttgggaggccgaggcgggcggatcacgaggtcaggagatccagaccatcctgactaacacgggtgaaaccccgtctctactaaaaatacgaaaaattagccgggcgtggtggcacatgcctgtagtcccagatactcgggaggccaaggcaggagaatggcgtgaacccgggaggcgtagcttgcagtgagccaagatcgcgccaccgcactccagcctgggcgacagagcaagactccatctccaaaaaataaaaataaaaaacaaaaaacaaaaaaacaaaaactaactcctaaaacataggtaataaaagaatacaggatcttcaaaaaaagaaaacagtcattaaaaactacagaaatactataataatttgacatctactccttaatttggcagtgccatacaccatgggttgtaagaaagaagagaatatatagtttaaaaaatgctattaatacttttctccagcccctaacccaacccactcatgcagtttttcttcatagaagaagagattttgctggtttgtttaaacacagaccaaaaatatgttcacctctgctcaatattgtatagctgacattctctttaaatatatctgtagaccaattggatacaaataaacattccaacactatatatacatatatatatatatatatgtatatatgtacgtatatatatgtacgtatatatatatacgtatatatacatatatatatatattccatatcagttgtttggggtttcttaatattacaaatttgtcttacaaattacataggagtagaaattctaggtaaggagatatgcataagttcagatgtaatagatagataatatcaaactttttccaaaatgtcttactaatttttatcccctcagcaatatctgagaacttcagtcgcttcacaatttgattttgtctgttttttttttttttttttttttagtcattgtgatgaacatgtgttggtttcttatggtttgttttcaattccctagcagttaagtttgatatatatatatatatatatatatatatatatatatatatctcctgtggaaattgataagctgattctaaaccttatttggtaatgagcacacagagagagccaagagaagccaacaaaccttgaagacaaaaaaataagcagaagacttacactatcagatattataaaactatagtaattcagatagcagaatgatgcaaagacaaacaggtcaatgaaatagaataaagtattcagaaataagcctttacatccatgaccatttgacttagaacagagagaacacgtcaagtagagtggagaaaaaaaatggtctctttagaaaatgatgctggtcaattaaatatccacatgggaaataaaaaaaaaaaaatcttgacctcctacatcactccaaacacacaaaaaaatcccatatggactgtaaatctaaacataaaatatgaaataaaatttttggaaataaacttaaaaaagtcatgtttttgtgttactcaaagagcttttaaacaagacaaaaagttgctcaacatgaaaaaataataaattgtattaaaagtttctgctcatgaaaaagcataaaaaatagggtgaaaatgcaagccataccttgggagacgatatatccaatacatatattgaataaagatatgcaatccagagtatataaagaattctaaagacttaatgagaaaacaaaacaaacaacagaatgtccagagaaaaatgttagaaagagaccaaaatagtcgccacataaagaggatacaaatactggcaaaaaatatataaagagacatttgactatcttaactactagggaatggtaaacgaagcacaagaaaccatcacatgttcatcacagtgactaaaaaaaaaaatcagacaaaatcaaattgtgaagcaactgaagttctcagatactgctgaggggatataaattagtaaaacatttttgaaaacagtttgatattatctatctattaagtctgaacttatgaatatccccttacctagaatttctactcctaagtatatttgtaatattaagaaaccccaaacaacttatatggacagtatataggatatattaactgtaatatatttgtacaatgaaattctctagagcaatgaaaatgaatcaattattactacatgcaataataacatagatgaatctcacaaatatagtgtgagaaaatgaatctaaacaaaaaatacaattttcctaagtctataaaaatatcgtaaacaagaaaaacaaatttatggttggaagtcatactagttattcttacggggatgtggagcaggaactggtaatgctctgtttcttgacctgggcactggttacactaccgtgttcactttgtaaatatttatctagctgcacacttagaatctgtgtgattttgcatatgcaggttgcattatgtatgcagcttgtaataaaaattatacatcaaaaatattcttttaggctgggcacagtggctcatgcctgtaatcccagcactttggaaggccgatgcaggcggatcacaaggtcaggagatcgagaccatcctggctaatacggtgaaacaccatctctactaaaaatacaaaaaattagctagacttggtggcacatgcctgtagtcccagctactcgggaggctgaggcaggagaatcgcttgaacctggaggcggaggttgcagtgagctgagatggtgccactgcatgtccagcctgggcgacagagtgagacactgtctcaaaaaaaagaacaaaaaaattcttttgatatcagcattcaacatatcttggggtctattggcttcaggtgttgatagtctttcaaattactatgagcctcactgacttttgtccttttctagattactgggtttctaagagaccataaatgtctagggggagaaatcctggaaatgagtaaaatgaaacattattaaagagagaattatctttataaaaactagtgtagctaccacataaagtttctggatcaacttgatggagatgcctagtttagatgttatttttgttcactagaatgcatttttgtgaatccaggcatttcattgcctgtttttgaaaaaaaaggaaaaataaaaaaattttaaagtctctgcaattctcagattttcagtgaattacaactaaccagtgcaaattgtattctctttatgcataaaatctctctccaggcctgcgggtttcccttaaggtaaattaattgaaactaataggaagaatcatttatttcttatggcttatttggaactaaactttcttcataacgcattttaaggaactcttgtactttaccgttcttattggaaatattgatagacaattcaaaattaagatacatttatagaagtatgaataaacaatttttaaaagctcattttcctcattttttccccttatattcgtgttatagatctcctgtgtcaggtcagtacagcacaaagttaatggaggttcaagacattacaggacatcttcagacaaaagtaatttttatttgcccaatttatcttctgaattgtgccttgcaatgcagccttcactttcagaaaaattctgagattttcaaagggagaaccaaatgtcagtattcttgctctacagatgatggaggatgtggcctttgaaacataatataggagagtacacacaatcatcactactctaaaacttataaaacctcctaaaagtaaatgcaagcttacctccaaaaatagtattccatacctataccttggattgttacacatttaatcatctgagagatacaaagacatttaataaatttctaatactgctagagtgcactcaaactttaaaatatatgagccaccagcaagtttaggaaaggcaaaattatttggccatttaccaaataaactactttattttcatgtatcatgtccaatggctcttcaaattcataaaaagtccttaaactctctactttaaaaataaagtatccaggctggtcgttgtggctcatgcctgtaatcccagcattttgggaggccaaggtaggcagactgcctgaggtcagggtttcgagaccagtctggccaacatggtgaaaccctgtctttactaaaaataaaaaaaaaaaaaaaatacaaaaaagttagctgggtgtggctttcacctgtaatcccagctacttgggatgctgaggcaggggaattgcttgaaccagggaggtgaaggttgcagtgagccgagatcatgccaatgcactccaccctgggtgacagagcaacactccatatcaaaacaaacaaacaaaaaagtttccagttatcagagcagctttacatctatgttttttttttttttttttttttttccaagacagagtctctgtcgcccaggccggagtgccgtggtggcatcttggctcactgcaacctcagacgcctggattcaagcaattctcctgcctcagcctcttgagtagctgggattacaggcgcctgccactgcacccggctaattttttgtagtttttagtagagactgggtttcaccatcttggccaggctggtcttgaactcctgacctcgtgatccacccgccccggcctcccaaagttctgggattacaggcgtgagccactgggaccggcctcatcgattttgaaacatccaagcttccctcattcttcagataattatagtctgggaaaagtagtccgatttctattataagtaatacgaattaaagcaatttttaattaaattacattcaaattaataggcataaattgtttgctaggagaatgatattttttggtgtcccttctacaataacaaacaaactgatttgtgtggagagggggaagaagagtaaaacatatgcagaattatttcattgtatactcaactgacatctaaaatagacttcatcttgtccacttatattaaaagaacataacaagaatgttttacttgttcagactaataaggagaaatgctatgtatcagcaactggtaatgttttttatggttctcaactagtacaggagaaaatgcaggattagactatttgaaacggaatatcaagtttcagttatataggaggaataaggtaaagggatatattgtacaacatggtgactatagtaacagcgatatattctttaaaaataaaatacagaatacagtgtagaaacagaatagatttttttgtaatcatctgtctgcatttgtgccacagaatttcaaaatgaatgtgaagtattttctaaaaatatatgatataatctaaaaataattgaaagaaaagatgatagagagtaaacgtaaaatatataaaggaaatcagagaaagtcagtataccacaatttgtattgcattcatcttctaaaattgccaaagatggatcaaatatttgactttgagtgtcggtggaaaaaaacaaaaggaaaatattaagtacagtatagcctgtgatcatataacaaaaatagcccagttgttcaggaaaaaaaaaatcttcacatttgatgtcaccagtgaggctaaataaatgtaaaactatgatacatggataacattcataaagctgtcatcaagtctgagtttctaatttggcaagaagtgaaacccacagggaagtccagggtgatgttattctgtgttgtaatcagcccaaaagagtttaatgtaaaatgtattttactaatttgaaatgatcattcatgcaacatatgttaaacaggttaaaagacatgagtatatgtaaaaataaataaataaaattttaagaagtcattatatgaaaaaggtacttgcacacacgtttatagcagcacaatttgcaattgcaaaaaatctggaactagcctaaatgcccatcaaccaatgagtggataaagaaaatgtggtatatatacaccattgaatactagtcagccataaaaaggattgaaataatggcatttacagcaacctggatggagttggaggccattattctaagtgaagtaactcaggaatggaaaaccaaatactgtatgttctcatctgcaagtgggagctaagctatgaggacgcaaaggcataagaataatacaatgaattttggggactcgggggacagagtgggaggaaggtgaggggtaaaagactacacaatgggtacagtgtatgctgcttagatgacaggtgcaccaaaatctcagaaatcatcactaaagaacttatccatgtagccaaaaaccacttgttctccccaaaatacttttttgctaaactttttttaaaacccaggggtacaagtgcaggtttgctatatgggtaaacttgtgtcaggggggtttgttgtacccaaaaattattgaaataaaataaactaaattaaaatcaataaataaaattttaaacaaacaccaatttgaaatgttaagcccaatatataatgtctttaagttgatgggaaaacataatgtctgcttagatgaaatttaaattctagtaggaaaatcatgcacacagataaacgataacagtataattggtttaagtgctaaactagacatatagtgattcagttacagggtcatagtcaagaaggcaatgcaccctcagacacctacatatgtttgctttgttcaaagtacaaaccacacaaggtcaaacaccgtgccaaaacatgaaggaaaccagacgagatcgggcgcattcagggtggtatggccatagatggaaggaaaccagtgattagtaagaccttgtgaaaacacctctcccttgaaaccatgagagagtttcctcatacttggcaatggggaaccaaaattagtgttttattggacctttacttcaggctggttcttgtttgcatctgttctatatgtaactaggaagaaaattgtcacaaaataactcactagctttcaagtaacataaaccacaaatactgtaaaacataaatggtgattttgatttcagaactaagtaatctacgctatttgacctctaaaatgtggttctcaagtataacagttgtcacaggacacttgacattgtaacagtaaataacacataaataagcaaaccatcagcttaaagattttaaagggcacctgcttctacagcaatatttatgtgagaagatatctgtggcacagagtgatggagcataaagtctcacagagagataagagcatgcccagaactaaatccaggtgattagaatgtcagtccagtgctcttccactggaaacgtggttgagcttggtctcggaagcagaatgccaggctgtaaattgtagcctcactcccaattagctgcacatgttgggaaggttacttattgctcctgtgatgcactgttctctgtaaattaaagagatgctacttggggaaaatacattaaaaattcagaaatgtgctggagatgttttacctaagacccaggtgagcaggtatagggctagagaccaggagcccccaggagcccccaggagccctaacctctgtctagaaacattatgtattaccctacattgttaaccttgtacatttctataccttttgctactaaggaaatttgcatcctctgaccatgactgtggcttttttctatctacggcatcactctgctgaaacctctcatcaccagtttgtgcttttgaaaatgtaataaacaatcagccattaagtgttaagtcttttttcttgctgctttttcacaatattattttcttttagtccataaatttcttaaatttggcatctttaataattcaaaaatagaatattcaaaatctttttaactttcagtagagatcaaatcaacattataactcaattcttctgacactgtttttccatatgtgcaacttgtaaagaatgagattaatcctcactgcattaacttctggaaaatatcttcataattcagagttttttaaaattaatcttgatcacatttaacatctccctgtatttgcaataaatgctatttttgcagttaagacaacatgcaataaactggaaaaattagttaacaatttgaaaagtgtttttaaaatcaaatcttacttgttaccttaacagggggtgtcacaatttacacagttcatctcaagttgaaaagaaatcggttgcctttttacttgtctcctaatttttcacagaaagttagtatgttctcttattttctagcaggattctacgcctcatttctcctgggaagcaatgtaagaggttacaagaaaagttcttgaactgaggtagacctaactttaaattccaacttcactgggtatttggctgagtaatactaggaaagttatccagacttactgagcttcaattttcccaaaagtgcaataagaaataattgcatctactgcataaatcaatgtttaaatttacttgttttattttaattgatattattttatttattcattttatttatttatttaaagagtgtaggctaaaataagtaaatgacatttcacagttctcagaaaaataataatgacaaataaaccacagttattattatgaattagggaatatttatccattaacatttcttcaaagcccagcagaaacaaaaagttaatgttcaaaggcctagcttcaactttccttcttcacacaaaaaattacaaatattacaagtattcatcactttttctatttcttttttgttgactacatagttgcttttttacagttctttctatattctggatactgctcctttgagatatatattttttaatagatgtcgtgagtatttgcttttaacatattgcttcactcagtcatttatagcacccttgttgcaggagtctgctattctgatgtaaccatattcatcagtcatttttcattagtgtaggacaggggtccccaaccctcaggccatggacaactaccagtcggtgacctgttaagaactgggccacacagcaggaagtgagtggtgggtgactgagtgaagcttcatttgtattaatagctactcttcatggctcacataacctcctgagctctgcctcctgtaagatcagtggcagcatcaggttcttataggaacataaaccctatcgtgacctgcgcatgaaagggttccaggttgcacaaaccttatgagaacctaatgcctgatgatctgtcactgtctctcatcacacccagatgggaccatctagtttcagaaaaacaagatcagggcttccactgattctacattatggcgagttttatcattatttcattatatattacgatgtaataataatagaaataaagtgcataataaatgtgatgcacttcagtcatccccaaaccatccccctctgcactcctgtctgtgaaaaaattgttttccacaaaaccaggccctggtgccaaaaaggttggggaccgctggtgtaggacatttcagttaatgatgttcaactaatggcctgccctagagaaggaggactcagaattgtggggaggctttttcaacatacaaggtaatgcagattctatatggcctcctgacaggctgagaggattagcatgttcccacaatgcacatcactcccatattgttgcaactggtgttttatgaaataaaatgtttaaaaacgcagtacatagtcaagaaaaataaattgactaatataaatctttacttctgaatttgaacataagcttcacattcataagagcttcaaaggaatgaattaaattaaatatagtttaaaaaattttaaagtttaaaacattttataaattaaaaatagtttaaaaaaggtgttcacattctttcaataaaagtgatgccctctctcctctttttctttactgtggtaaaatgtacgtaacacaaaagttagcatttcaaccacttttcagtgtacagttcattgacattaagtgtattcacattgttctgcaaataccactgccattcatgctcaaaacgtcttcttcttcccaaacggtaacagagtagccattaaacaacagcttcccatttacctcctcccacttcacccctaaaccctggcagccaatattctgctttctgtctttatgaatttgcctactctaggtaagtagagtcatacaatatttgcccatgtctaggttatttcacagagcatgatgtcctcattaatccatgatgtaacatgtattagaatttatttccctttaggactaaataatattccattgtatgtgtatatcacattttgtttattcattcatctatagatgaacatatgtgttgtttcttttccctttttttttttttttttttttttttgagacagagtctcgctctgtcgcccaggctggagtgcagtggcgtgatttcggctcactgcaagctccgcctcctgggttcatgccaatctcctgcctcagcctcccgagtagctgggactacaggtgcccaccaccacgcctggctaattttttgtatttttagtagagacgggggtttcaccgtgttagccaggatggtctggatctcctgacctcgtgatccgcccgcctcggcctcccaaagtgctgggattacaggcatgagccaccgcacccggccccatatgggttgtttctaatttttagttgttgtaaatagcacttctatgaacatgggtgtacaaatacatgatcaagtctttggtttcaattattttaagtatatagtaagagttatattttaactgatattaactaattgttttaaagactaaagaaaaacgaattaccattggattttcttttcgcactcctcataattaaaatgactgattacttgtcactaacggaaatcaacttcgtagaaccagttgtgacacagatacccagcatgaaaccatagtaaatatagatcttctcagataactttttgttctgtgcacttttgatacaattcatgtacttaaatgtgacatgagccttcaaattattgagccagaaatcaagtatctacatgtctgtatatatctttgtcctagaaaatcctcaggagacctcccttaacaatcactgctcaaaaatgactcacatatccacgtgcaaaccaatcatttgcaaaggtaacaggacaggcatgattggctctgaccagccatttttcaccactttggaataggcttcacttcccctgaagcacatgatccccaaaaataatacctaaataaaactgaaattctgttaaagtgtgaggtaggagaaatagccaactaatggtgtctactatactcagacaatgtgagtatattaaaaccagagacttcacctaaattaactcagtggtacaaacagaataatttaaaactcaccttcacctaaatttcagataattatattattttccactcactatagtataaacatgaactgaaactaaattaggtattttgtccatctagatttaattataacatatgtttttatttatttactttttttcgggggggggtggtctagtttactagaatgtggcttctgtaagggtagagagagcctatttttgttgcttccatattttcagtacagagtaagaacacagtatatattttctttaaaaaaatgaacttagaacctaagtttttaagtatattaggtataccacttcagagcagatatacaattgtctttattatgttattacttatattggataattcacttcaacaatgtttttattgtgtcactttacctgtagcatattttaaaaataatgccccaaattcactactcatcttttaagctaatatagccttattcactgctatttcaaagtcttatcttactttgtcaatcttattctatgtcacatttcttctttcccttcttacacaaagcacatatttacatttaacttttatcattctgcgttatatcatggaccaaaaaaaattaacttgtatgcatggtagatgatctaccattacctaatattgtatagcaattggtagaaacacctctttcacaatcatgggctacttcccatttttaaaatcatctttccttccttcaaacaccacagctgaactggtcctgattcagtgctgtttgcattaatatttttgttgctctaagtataaaatgagaagaactgcttaactcatgctctgattaaattctggaaaggagatttcaggcttcaaggctaaaggcagcaactggaattgttaaacattaagtatttattactcccttccgctcgtaaatcccttgcctcctatcactcagatacgctctgcactttgtttcttctgagttttggcttacttagtttgtttcctctacttagactgtgtcttcctcacatatgtttcactttggaaaaaaaaatctaaccacccttcagtgctagtcttaaattcttcatcctccaggaaacctttatgttcattcaccaactgaaatgttttcttcctttgaatccacaagacaatttgcgctctgctacttgactttattattatagcatacacttgcataaacacattctttctctctctctctaaactttctctctctctctctctctctctccccccctctctctgtctgtctctctctcccctctttctctcactattgtataaagtacctagtatattatattgcatgaagttggtttcctagaaaggacccctttccctagtctgaattacccactgatagtttgaagggggagggttccttagagttctcagtagtctggagacacaatcaatcccaacactgtatacttcatctgaagaagtccatgcattctgtccagggcatatgtcctcaccctgatgcttctttcaatgcaatgtctttacacaccttattaagactcagtttctcacctgacttttacactactaccaaactttcgccagaatcccttggaaatcacagaccatcatcaacaaaatcccctaaatgttcaactttccctctgagtattacctatactttttgattccttctttctccctctaaccatcctcgacaaaagatgctgctttctgtagatctcccagtagtggctaccataatttacatagcacagagcccaggagtacagggcaagcatccttctgtctcctttgacactctgtcccaattcctctgaagtaaatcccatcagataatgccacccactaaatttccttgttatagtcatcacatgccttttgagtaatctcctttattaatggactagtttaacatttggcttatctttttttcctacatcacactataggattagtaacataagtggtgatgtaaaaatccacaagggcattctaatcacagtagcatctgacagtcaacgatcctcttttatcaatcttgttctttccatggttcagggaccttgcattttccctgtattcctgtcacctcatggcagcaacatctcagtatccccaaacccttcttctcctgatctctaagtgctgaaattcccaaagcttagtcttcgtattttttttgtcaaacccattttcagggtgatttcatcttggccccttatttctctctcaagtctagatcagcatttgcaaatgccttgccaagaattaggtttctgtattgaaaaagcctcccaaaccttgattactgccatcacaataggcagtggaggaggtatggggatctgttcaggacaaaaaccaccaagtcattcttgatttttcctaatgtcccatgtatgattcatcggcaaatcctatatgttctatcctttaacccccttctcaaggtctccatagcctatcaacgtcgttcaagctaccgtcaaatttttcctggactcgtcatgcattaaactctacttgtccaaaacactgtgttacccattcccaacatcccccatgcagcatctacaataatctttttatattggatgatgtcataactgtttaaatcattcaaaggctttctttccaacacacctagaacgaatcccatattctagccccaggtacatttctgatctcatttcctaccagactttttcattcacactagcctccagctccctgtctacctttagggctttacagagaaatcccagaatgctgctcacttaagaatccatgtcttgatcttttcctttattcaggtcactgtttcagttttatccaaaaagaactatcttaactttcttatctaaaattgcaccactctcattcttcccttatcaaacttttttgtttccttagaatttatcactacataacttactcatctattcatttcttcaactagtttgtctgcattactcgggtggaaactttgtttgtttgtttgctttgtcaattgctctatatcaaacttctagaacagtgtttagcacattataggtactcaaacatatttgactaaatgatagaactaaatcaattaagagttaatgagactaaaatataaaataagataaaaatcagctacaaaggattcctacttgtggataacaacataaattaaatgtaatgaatgacagatttgtggactacttttagttaaactggtgattcaggtcaggggtctgtacttagcatagtggaagagctattttgcaagcccaacccaattaggttgaattttttttcttactgagagtgtttgataggtgataaaactacacgtaagaagagctctaatcatggtgctcctggtaataggaaaagaaaggcaattactcatgtgcaaaactagaagcaatcaaaagctagatttgccagagatgtttaggttttatgtgcaatttacagctatttacaagttaaccattgaaatgctgtccaaaattaactccgcaattgagaatccaaaatgtttagcatctaaactttttcctcagtaaaattcaatctttaaaattttttcttagtaataaaacattagtaatacacagttgattagaaatagtcataaacatttgattataaactattataagagtaattagtaataaacatttgatgataaataaagaaaaaaattgaaaacttacaactttggtcttagatactgcatttttgaaattccaagtaagccaacattctctgagacatcaaggtttttgtaacttttagtaaagtactaaaactggtagtgttatttttttactttcattcaatcagcatttaaaattcacaatttcagaaaaaaatggttaatttattccactatttcttctattagaagtggtaattttatatttgtcattagagatttcattttgagaatcttttgagttatcctactggaggaatacaaaccattaagaaaagatatacatttcaacatcttattcaatgtaaaacatcgtaagtattttgttaccattttcatagtaaaatgaaactcaagaagttgcttagtgtttacctgatataatctgtattgagtttagataactaaactaatatagctccaagtttcaggcttttgtttatacagcataagtatgcagttaatgcaaactacaggcttacagcttatctgcaaaacctgagcttttactttagttctgtatattaacataattccgcataccttcactctgagtacagaagtaaacattcttgcatcttcagatacacctccgatgtagaattttttctgaaacactgggggatgattattttcatcctgaatctcaatgtatactttagctgtattgcctggaggacaagaaacgatgcattttttattggtggttattcatgggggaaaaaatgcactgaagtaaatatttgctgcacttttttttggaaacattgaaaataaatcaaaagccatttctagatgccatgcctagcacccccaaattcaggggacactgataatgatgcttctggtataaaaatgttaagttgctgttatttcttttaattacaatgtcctggtagttcactttacttgatttaatttggcactaaaatactgcaccctgttaattttaatgaaacaactctactgttcacgttcacaaacacttcacacacaataccagttataccaaagggacacaaatatataaaccccttatgaaatagtagaaactgccataaactattatatgaatatatatttattcttaagtataaaatcagcaatggcatttctttagcttaaaattgtacaataacttttatgttttaagactaaaagtaacagtgttcgggtgaggtgtttatttccacaaatggaaaacaagttttatcatgccttggaaactgtcaatgttagaggctaacattcattgaaaacaatggagctgaagatatgattatgactcataaatgctgcattttaccatttaaataacagtaaatgtaccataaatgatatgtcatcatcaaatgttagaacctccctcaaatcatcacacctttaatgagaaatgtggtacttgtcactagtccaataatgaccttttaaaaaacaatttaatatgtataaaaataacttataaaccaaataaaatgggaaataagtggctattcattttgtaaaaaaatagtcaaataagtattgctaatgtattacataagtcgacttttctgattcatttcagttatgaacaaacggcaattaacgtacatactatttatcaaggatgcccttattttggtgttttacctgtgtttaatgcctcctgtacaattttaagtaattaacaccagcctacttgcaggatacatcatgggtatacatttgtatttgttgaataaattaatgaatgaatagcttgtattagtaagaacttagaaatagtcttttttttttttttgcttgcccttggaaaggtcagacagaacagtgagttaacctcaagattttgctcctatcctgctgctactcattcagcttttctctgtttgtcatctgtgacctggaagaggtagaatcaagaggaaaatcatgctagcgcaacagattagagaaccaacagcgaaatagggctaatagcagattatgcttctctatcctgcagtgccagggctctgacttgtaccttagtcagccaccacaaatcagaattcacccaaaatgaaatcatttttagttcagtagcagaccacttttatctctagaataaaaaatgcgaacagctctaaatttaaaaataaaaaggaattttagaatatgtcacctttccaataacttctttgcactttcattcagaaacatatacaattcaaatgtgctatttcttttcagaactcttagagtgacagaggtctcggaaaaatactgatgacgtatattttcttctttaaatgggatgagtcatttaaaatgttatacaatttgcaaagaacaagaactttgtcatgacctgttcccttacctcccaaccctaacttcatatctggatggtaaccaaatcctacatgtcagcctcataagcaggtaaatcatcacctaataaatatatcttgtgtcatttttctctcaactccacagctgcccatatacttaagtctgttgttgtctcacctgagtgactaaacgtcatctgctcccctgtcgtgtctttctaatgtgtcctgcattctgatataacaaagacatcacaaaatacaaataggatacattaaatcaaatgttaaaccaaccaccattcatatgtacatttttttctttttcttgttttttgagatggagtctccctctgtcgcccaggctggagtgcagtggcacgatctcggctcactgtaagctccacctcccgagttcatgccattctcctgcctcagcgtccctaatggctgtgactacaggcatgcgccaccatggctggctaattttttgtgtttttttagtagagacgggatttctccatattggtgaggcttgtctcgaactcctgacctcaggtgattcacccacctcggcctcccaaagttctgggattacaggcatgagccaccatgcctggccgacaattcttaaaaataccatgtgtatattcatatccatacttatatgtatactttgtgcatataagtttaagattcaaataccaaattgttcctatgaaagctcctttgattcagtggcctgtatcagatattaagtggtttgtgggaaaaggcctatggataacccaaaatatgattatataacctgaacataatggggagagatgattatacttaattataatattttaattaaatgatatttatttatatgaaaactaatgactatacaatacaaaattccagaatacttcacaaccagcacacaaacaaaatctcaagaacattgtttagacttaaaagaacttatacatttatttattttaaaaagccacgatcatttagttcttttcacaaaagagaaacagttataatgcgatttataacaatactgtatcatgaattttgaaatttatgatgttagctatatagctaattatgtaggatagtttgtaatagtcaactaaaaataaatataaagttgtgaaaaaggtgttttcattaagtttgtgacttagatgttagaataaaaaaaattgttaacttttattttccataatgtaaaatagactagtcttcctttttttttgcttctccctgataactttaggcagttgttatgtatccctcctttgaaatgctatagtgcactaaaaatgtttctttctataaataacctttccagagcttggtttacattgcatttagttataagcatgattttattcttattagatttcaatattcttaaagatggaaattgtatctcctacatctatcagtactataatgcctcagtttgtaggtaatttttccgctcagatattattgtaacaaaatttcttaatttttgttgaacaaaaaagttgatattcaattaatttgttagctttctttgattataatcatgagattatgattaactgaaacaaaaagttaactcttagaaggatatgagggagctcactaaatcaaagtgaagtaagtccaaagaaggcttttggtaccacaaaataatcaggaagttgtagagcctttaaagcagcagatgtttgattttcttgcagatgaaataacagcaaactctcttcttttatgttattttaccccaccccttattcctctttttttttttttaaagaaacaaaccaaaaaacaacccactaggcttaagaatcataccctggggacacattacctgactgtcctagtttgggtcatgtgcttgctccttgtctcgggaaggagaagtcaccagattatccacttgagaagtcactgggacaattataagaaattgtagtgtgtctacttaaagaatgtaaaataaatgttggccagtaagaaaaggaaaagcaaataagtatacacctatagttaaatcactagaacagcgttctttttgacttttttattcatgtgtatacaatgtacatgacatcatcaatttccttggctcacgtgcttccccactaaggattgtaccatgttcttccaccaaatttggatattgattatttcaaggcagaagcttggaagcaactctgatttaaattcttttaagatagcctgctttttatctccttgagtacttacaaaaactttttttccatgttgtatcctttatttaatgtagacatcaaacacataacaaaagaaagatactagaaagagaaaggaaagcacagatagaaaaataatgttaagggaacaacgtgcgtgcctaatatcctagtattcccctccagtctcccttctggctcatctaaacaatgcaagtattggaaagagaaccacaaacagtgaaagaaattacaaagtaggcaaaaaagttatttggaaagtgttttggttaagagacattataatttttctgtgtgctttggggcaccctgccttatttttcttccattattaacttttttctccaattttctatgggacaatcttttctttggctagaacttttggctttagtaagccagaagttttaaaaatgactcctgaggtaagaaaatgtgagataccttcttgcaatgttttaaagaaagagaaaataatacttttatgtagtcaagctcaggggaaaatgtaagtcttagtatagttacctccttgaatagcacttctgttctattttagacatttaaacatggtagaaggagttcagaagagtgattttaaatacccattaacctcaacttgactctatgatttttaagaccaaatttagtttgatttttcccttcccttacttttaataatcaagactgtgatgctagttttttctttttaggaaggccctattatcctcaagatgaatccatttcatttatccacatgactaatctagtgcctacactgcactggattttcaaagaaagccttactgaataagaagccaatgagttaaaagtgttctcaactgggatcaatttggctgctctagagccatttttggtagtcacaacagtgtggataggggaacgtagtgctactggaattaaatgagtagaggtcaggaatgctgagaaatattctgtgatgaacagaacaggctcttaccccaaacgaacaaacaaacaaacaaaatatttgggccaaaatgccattagtgatgaggctgagaaaccccaagttaaataacaagagaaagaggaattagatgagttaagataaaatggaaagtttccaaatgctatagtaataccctctcctcaatccatctgcatgcacatgcctttaatgtggaacttatcaaaatatgctgtaattatttgatcacacattggttatactcttttttgactgtgtcctataaagtcaagggctcaagcctgtttacctccactcttgtcactgccttctggcctctgttcctgacattctctccatctaaaatattcttaattccaagccatttctctagtcattgccagtaaatatacatcacagaaatatttattcctgtacttgggaatgtagaagtttagtctgattaaaaaacatacactagactatattttcctcaaaccttaaaggaaaggactgtgcttttcttattgttacgtatcgttgcctaacacattaaatgatttttaaaattgttatcatgataaatgatttatagattcttcaaacagtcctattgcagagaattttttaaatgcttggaataccagatttatatttgttaatttgttggtatcaggagattgaagtcagttcctcactttaaaaacacacaaacaattttttatgctgtttttcttttaagacaatttttgtttaagctttacgggtatattaattatggaagcattgtgacttccacatagtaggtgatatggtttggctctgtgtccccacccaaatctcatcttgaactataatcctcacgtatcgacggaagaacctggtgggaggtgatcagatcatgggggcagttttccccaatgtgttctcatgtagtgagtttgcacgaaatccaatggttttataaggggtgcttccccctacactccctctttcctgctgccttgtgaagaaggtacttgcttctctttccccttccaccatgattacaagtttcctgaggcctccccagccatgtggaactgtgagtcaattaaatctcttctctttataaattacccagtctcggttatttctttataccagtgtgaaaacagactaatactgtaggtgttcaataaatgttaaattaaattgtaattgctaccacttcactactcccaagggtcctcttaaataaaataaattactctattttattcctgtaaattaaatgaggtaacagatttttaagcatttaaaaatcaaataacagacacccccattccaagacagctgaataggaacagctccagtctgcagctcccagcgtgcttggcgcagaagacgggtgatttctgcatttccaactgaggtacctaattcatctcactgggactggttggacagagggtgcagcccacagagggcaagccaaagcacggtgggacatcacatcacccaggaagcaaaaggggttgggggatttccctttcctagccaagggaagtcatgacagattgtatctggtaaatggggacagtgccacccaaatgctgcgcttttccaatggtcttagcaaatggcacacaaggagactatacccacacctggctcagtgagtcccatgcccacgaagccttgctcactgctagtgcagcagtctgagatcaatctgcgaggcagcagcctggcagggggagaggagttcaccattgctgctgcttgagtaggtaaacaaagtggctggggaagcccaaactgggaggagcccaccgcagctcaacaaggtctgctgcctctgtagactccacctctgggggcagggcatagctgaacaaaaggcagcagaaacttctgcagtcttaaatgtcctggtctgacagctctgaagagagcaatggttctcccagcacggtatttgagctctgagaacagacagactgcctcctcaagtgggtccctaccccagtgtagcctaactgggaggcacctcccagtaggggccgactgacactgcatacaggtgggtggctctctgggatgaagcatccagaagaaggaccaggcagcaatatttgctgtgctgaagcctccgctggtaacacccaggcaaacagtttggagtggagctccagcaaactccaacagacttgcagctaagggacctgactgttagaaggaaaactaacaaacagaaaggaatagcatcatcatcaacaaaaaggacacccacaccaaaaccccatctgtacgtcaccatcatcaaagaccaaaggtagataaaaaccacaaaaatgggaagaaaccagagcagaaaagctgaaaattctaaaaaccagagcacctcttctcctccaaaggatcacagctcctcacaagcaatgaaacaaagctggatggagaatgactttgatgagttgacagaagtaggcttcagaaggttggtaataacaaacttgtccgagctaaagaaggatgtttgaagccatcacaaggaagctaaaaaccttaaaaaaagattagacgaatggctaactagaataaacagtgtagagaagaccttaaatgacctgatggagctgaaaaccatgcacgaaactacatgacacatgaacaagcttcaatagccattttcatcaagtggaaaaaagggtgccagagattgaagatcaagttaatgaaacaaagtgaaaagagaagtttagagaaaaaaagagtaaaaagaaatgaacaaagcctccaagaaatatgggactatgtgaaaagaccaaatctatgtttgattggtgtacctgaaagtgatgaggagaatggaaccaagctgagaaacactcttcaggatatcatccaggagaacttcctcaacctagcaaggcaggccaacatacaaattcaggaaaaacagagaacaccacaaagatactcttattccaaaattgaccacatagttggaagtaaagcacccctcagcaaatgtaaaagaacagaaatcacaagaaactgtctctcagaccacagtgcaatcaaattataactcaggattaaaaaactcactcaaaaccgcataactacatggaaactgaacaacctgctcctgaacgactactgggtaaataacaaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattaaaaactagagaagcaagagtaaacaaattcaaatgctagcagaaggcaagaaatcagagcagaactgaaggagatagaaacacaaagaacccttcaaaaaaatcaatgaatccaggagctggttttttgaaaagatcaacaaaattgatagactgctagcaagaccaataaagtcttgcaccatcacaagactaaaccaggaagaagttgaatctctgaatagaccaataacaggctctgaaattgaggcaataattaatagcctaccaaccaaaaacaaagtccgggaccagacagattcacagccaaattctaatagaggtacaaagaggagctggtaccattccttctgaaaatattccaatcaatagaaaaagagggaatcctccctaactcattttatggggccagcatcatcctgataccaaagcctggcagagacacaacaaaaaaagagaattttagaccaatatccctgatgaacatcgatgtgaaaatcttcaataaaatacccgcaaactgaatccagcagcacatcaaaaagcttatccaccacgatcaagtcagcttcatccctgggatccaaggctggttcaacatacacaaatcaataaacgtaatccatcacataaagagaaacaacaacaaaaaccacatgattatctcaataaatgcagaaaaggcctttgacaaaattcaacagcccttcatgctaaaaactctcaataaactaggtattgatggaacatttctcaaaataagaggtatttctgacaaatccacagccagtatcgtactgaatgggcaaaaactggaagcattccctttgaaaactggcacaagatagggatgccctctcttaacactcctattcaacatagtgttggaagttctggccagggcaatcaggcaagagaaagaaataaagggtattcagttagcaaaagaggaagtcaaattgtccctgtttgcagatgacatgattgtatatttagaaaaccccattgtctcggcccaaaatctccttcaagctgataagcaacttcagcaaagtctcaggatacaaaatcaatgtgcaaaaatcacaagcattcctatacaccaataacagacaaagacccaaatcatgagtgaacttccattcacagttgcttcaaagagaataaaatacctaggaatccaacttacaagggatgcgaaggacctcttcaaggagaactacaaaccactgctcagcaaaataaaagaggacaccaacaaatggaagaacattccatgctcatggataggaagaatcaatattgtgaaaatggccatactgcccaaggtaacttatagattcaatgccatccccatcaatcggccaatgactttcttcacagaactgggaaaaactactttaaagttcatatggaacaaaaaaagagcccacatatcccagacaatcctaagcaaaaagaacaaagctggaggcatcatgctacctgacttcaagctatactacaaggctacagtaaccaaaacagcatggtactggtaccaaaacagagatatagaccaatggaacagagcagagccttcagaaataacaccacacatctacaaccatcttatctttgacaaactgacagaaacaagaaatggggaaaggattccctatttaatgaatggtgctgggaaaagtggctagccatatgtagaaagctgaaactggatcccttccttatatcttatacaaaaattaattcaagatggattaaagacttaaatgttagatctaaaaccataaaaacctagaagaaaacctaggcaataccactgaggacttaggcatgactaaaacaccaaaagcaatggcaccgaaaaccaaaatagacaaatgagatctagttaaaataaagagcttctagccgggcgcggtggctcacacctgtaatcccagcactttgggaggctgaggcaggcgaatcacgaggtcaggagattgagaccaacctggctaacatggtgaaatcccgtctccactaaaagatacaaaaaaaaaaaaaaaattagctgggcattgtggtgggcgtctgtattcccagctactcgggaggctgaggcaggagaatggcgtgaacccgggaggcagagcttgcagtgagccaagatggcgccactgcactccagcctggatgacagagcgagactctgtctcaaaaaaaaaccaaaaaacaaaaaacaaaaaaaaacaaagagcttctgcacagcaaaataagctaccatcagagtgaacaggcaacctacagaatgggagaaaatttttgcaatctacctatctgacaaagggctaacatccagaatctacaaagaacttaaacaaacttaccagaaaaaatcaaacaacaccgtcaaaaagtgggcaaaggatatgaacagacacttttcaaaagaagacatttatgcagccaacagacacatgaaaaaaggcccatcatcactggtcatcagagaaatgcaaatcaaaaccacaataagataccatctcacaccagttagaatggcaatcattaaaaagtcaggaaacaacagatgctggagaggatgtggagaaataggaatgcttttacactgttggtgggagtttaaactagtttaaccattgtggaagacagtgtggtgattcctcaaggatctagagctagaaataccatttgacccagcaatcccatcactggatatatacccaaaggatgataaagcatgctactataaagacacatgcacacgtatgtttattgtggcactattcacaatagcaaagacttcaaacccacccaaatgtccatcaatgatagactggattaagaaaatgtggcacatatacaccatggaatactatgcagccataaaaaatgatgagttcatgtcctttggagggacatggatgaagttggaaaccatcattcttagcaaactattgcagggacagaaatccaaacaccacatgttctcactcataggtgggaattgaacaatgagaacacttggacacaggggagggaacatcacacaccagggcctgttgtggagttgggggctggcggagggatagcattaggagaaatacctaatgtaaatgtcgagttaatgggtgcagcaaaccaacatggcacatgtatacctatgtaacaaacatgcacattgtgcacatgtaccctagaacttaaagtatataaaaaaaaataaaaacaactgcatgttgtttcaattaaaagcaatctattacaaacaacagatttctctaaaaagtttaactttaggaaaatattgactctgaaaccattttggaatttgatgggctatttgaaaacatcttgaagattctggtttttatatcattattaattgtctttatgttcccctgttccagtttgtattctggataatatctggttctataggcaaattaatgtttaaaacaaaatgatcatctgagataaatgcttaagctgttcttactaaggggtttatagatacatatttttgaatatacaggtggaaatacatatttttactacaaatagaataatttatcttaatttgtgtatttttaagttattcactaaaaatataaagtagaatttgagagaaaagagagaaatatgttatagtgtgcccactagacagaattaacaggaacaaaatatacttacaaaacatttagaaaataaattattaactgtattagcatgagaagctcactggttcttctcagcttttgctctgcagagattatatttagctatatttttatatactattcattttcagtggctaggcagaaagatagattgatcttttgtggttcatttcaatagttttcaaatttagcttggacatttaattaattagcctttgcataatattaattgcttgtatctagaagaaatattttgtgtatgtgtttggctgataggttaataactgaattgagtaaataactgctgtcactactggctccaaaatgtgacattcatatttccttttttttgagacagtctcgctctgtcatccaggctggagtgcagtggcacgatcttggctcactgtaacctccacctcccgagttcaagcaattctcctgcctcagcctcccgagtagctaggattataggtgcccgccaccatgcctggctaatttttgtatttttagtagagacggggtttcactgtgttgtccaggctggtctcaaactcctgaccttgtgatctgtcgcttcagcctcccaaagtgctgggattacaggtgtgagccactgtgcccggcccgtatttgtataatatataatacttgattttggctaagtcttttcatgaagaaaatgacaacactgacactttgtcattcctcagtatctgtgggggattggtcccaggacccccttctgataccagaatccacatatactgaagtccctgatagaaaatggccatagtatttgcatataacatatacacatcttcccatatcaatcatctccagataacttataatacctaatacaatgtaaatgctacataaatagttgcatactatattgtttaaggaataatggcaaaaaattctgtgcatgttcattgtagacacaaccatccatttcttttctgaatattttccatctctggttgtctggattcacgaatgcagaacccatggatacagaatgccaactgtatagtcatgaggaaataatcaggaaaaaacagtaatattctaagtattacttaaattttggttttgaatccattttaacatttttttcctcctggaaagattttatgactaaatttatctgcaaattgtaatcaccaaaataggagttaaggatgcaaaattgtttgttttcattggtactgccaacattttgttattcctgagttcaaacggatacatttaaaagcctctgcaaccaaatgactgtgacttttagctcagtttctgtgagaaaaaaagacactattttaaatcatttttatttattaaacactagctctctacaaaaagcagctattatgatattacaggactataatgatcaacaaaactgtagtagttgtaatctgggcaataaaactttaagcataaactttggaagcagagcctgggtctaacctgataataccacatgtatgctgtgtgaccttatacaggttacttactctctctgaggtaaagtttcttattcataacatgatagtaattttacataaataaccagattaaatgagcaaatatatgtaaggcattaaatacatggtagctttactatttcatatatgcctcagagattcctggctctcaaggcaggagggagaaaatattagtaacattattactaataccagaaggaaaaaaaaataccaatagcatgaaattgaaacaaaatttcctagcactaaattttaaaagaaaatggtttttatatgagatatataggaatatagtacacatcaaataatgtagtggaaaatacatatttttagtgcaagtaaaataattttatgaaatcataatgaaataactattggaaaacatatgaaaagtactgtgtcctattaaatatgcatacttttgtttacacaagaccacaaatttatagaaaatttatttcaaaagctgagagttcaagaaaatcagacagtatataatatttgacctaagactattccactgataatacaagccgaataggaattattgtacactgaattgcaggatcatagctgaggaagacaaaattattatgtctgaatagaccattaaatgacctctgaattctttgacatataattaaaaataaaagcatatttatgccccaaaactaatgctttgtttaaataaaaaaagatgaataaatttactaaaataaataaacaagctaacagaaaaacaatcaaagatgcaaaaagattgtgttgtggaaatgcaatttgctaagcacttgaaaagatacatgggctgtagttattgtcacatgggcagttttgaactttcatatatgcacctaaacacagacacacacacaacagatattaacactatgttcttttttttcttgagactataaaggagctgtttctaaaagataagagaagaatccatcaaaaagaaatgaacacactgatacggtttggatgtttgactcccctgcatctcatgttgaaatgtaatccctagtattggaggtggggcctggtgggaggtgcttggatcatgggggtggacccctcgtgaatggcttagcaccatctccttggtgatgagagatttctcactctgagttctcaagagatctagatattgaaaagtgtgtggcacctccccctccctcttgctcctgctctggccatataacgcactggctctcccttcactttccaccatgattggaagcttcctgaggccctcatcaagagcagatgccagcaccacacttcctgtacagcctgtagaaccatgaaccaagataaaatatattttctttataaattacccagcctcaggcattcctttgtagcaatgcaagaatggcctaatacacaaaccaaatatggttttccatatttaatgggaggaatggaaggtgcgttactctttcttgaagagtttctctacattagacattttacttccaatatttctttaaaaaccttgcaacaaatccatgaaataggtattttcattctgctttgtagataaagaaactgagactcaaggagattaaagaactagtcaactattatacagaagagccagacttcattcccaggcatggttaaattcatgcccaggtttctctccctagttaaaacaagatttgtaataacagcaaaggtaaattccattagacacttttgctcagcttctagaatacaggcaatcaaatagtagtactgaataaagaattattgaataaaacgatacgtctatttcaaaagacagacaagtacagttgccccttctatatttggatatcaactgaagagttattacaaatgaattaaaggatttataaatgtctatggtattgttgaaggaagagaaaaaaatgcctttcaaacaatgtgctaaattatttaatgctgctcaaataggcgcctctgtcctttaatgcaaatacacaaacacacacacacacacacacacacacacacacacacacacacacacacacacggataccaccatagcttcctattgcttctgtaatagattacggcaaaattagtggtttaaaacaacaccagtgtattactgtatagtttgtaggtccaaatgggtctcactgggctaaaattaagacgtagcaggtctgcatttctttctagagcctctagggctgtatctgtttccttgtcttttctagcttctagaagctgcctgcttgcattccttaagcttagtgtcctttcatcagtcgaatctagcaatggccagtggattcttctgttgcatcagtctgacactgactgtcctgccttctttcacttataaggattcttgtaattgcattgagtccacccagatagtccagaataatcaccctatattaaatccttaatccaattacatctgggaagtcccttatcttatgtaaattaatatcttcccaaatttcagagattagggcatagatgtctcaagagaagggggcatcattctgcctacaagaggcatattattgtgttcttttcaatgtaaaattcgaaggatctactacatttaaaaacagaaatgtgttaggatgttcccaaatgacaaatttaggaaaaacaaaattctgttttaatacaaatatgggagctctcaagctctttttatgtgcaaacaacatcactgacagaaagctttaatggtaatactaatcactgagaagtttctggaccaagtgttttctgtgcattatttcaatttactcctgtaataacattgtacatattattgattgtccacattttatcaatgaagataatgaggcttggagggattaaataacatgtctaaaattactcaactaggagaaggcataaataagattcagactgaacccgtaacaacatatagatgtaactatttcactttatggccttaaatttgagtcattttttaaaaacctgaagtaatccttggatttgtgatttatggggagtggggagcaaggcggtttatttctatagtgaaaaaaataatttatttgtatttaggtattaggtatttaggtatatacttctatgcctaggaccacaagaaaaatgaacatttcactgggaaatttctaaaactttctaagtttttataaatacccaggaagccaagaatatagattgctagaatggggacagggaaagcaaacctacttctaaactgcatcaggaaaataatttaaggaatatgtagataatctggttggaattaaagcctcccagtggaagtatttctatatgccttcatttgaaaatatctctttcgctcacctcataacagcttgaggcaaagtaaaaacagtatggatacaagatgagaaatcccatttctataaagttgaggactttttcatcttgcacaaggcggttgaatacaagggcctgctttctcatgtataaactgtagacaaacaataagattactgtgatgattaaatgtcatcataaacaggtatatgtttataatcaccatacacctataaaacattagaattgtctataaaaagtgaaaagtgttatggcatatattctattttcaaaacatttgcatcttttaataaaaatagtggataaattatgtaaaagtgcatataagtgtatgtatagatactatataagtatatattaggatattacaatataattgaaaaagatatataatttaaaaaaatcaaaatcacgggatgatagattattttaattttcttcttttcgtattttatttttattgtatataatgataagtactgcttttctaatttaaaatagttaatgttaatgttatgatggaagactagaagtagagcggaaacagaagtcataaagcatacgtacacgaaactcttgaactttatctgttcctttctatgccttttctaaaatatctctttcatctaaagaacctgtggagatactatgtgcaaatcttcattttcttttcctccatcaacaagccctggcttacgctagtaaagcatacattttttttcctcctgaaataaaataagaattttcctgcttgtttgcgaaatatttccctaggtatattggatttactcgtgaagattcaaccaagaagcaatgaataaagagagaagtggccttgaaaaacacagtctaattattatttatctatatatctttgctgtgttcattagtcatatggtatacaacatattaaataattcattttttgcacaaattttagaagtaatataagtggaagcaatttaactacaactacttagtgtaatgaacattttaaattgagcttttggaaagtgcttaattaatacttgtaaaataggggttcacagttcttgcaatatgtcattaagtccaagcattatctttaatcttctcccaaacttctgagaggagaaaatagtttttgaagcaacacaaattgataaaccttcaaaagttgaggtaatcagctacttacatttttgagcactagtcacagtataaatggaaattaaaattccattatgacataaagtaaaaatttagcactgtaagtttcaagtaatatgccacccctctacaccaaccttaccaagcacttcattcaaccacatttcagccctaatatgactttttttttatttgcctaaacagtatcacttcctcctttattttggcctcagaagtccattttccctccttggtttactattacctccacattccatgagtccttaatagaaatgccaactattgtactcttcacttcacccctggccaaggatacacagctcaagccaggccaatcagattctctcaccttcagatgtgtgatccttgaactgactgccagttgcttgaaggtcattgacctcagctttcttaatggcactgcccaaaaaggaattgctacttgagtttctaagattgctgaagcctctccatgtttttgtttttccttagaccctattcaatttctctcttgctgtacaagccaccaagtattcttctgatatgattcctttagtataagccagtcagaagtggtttctgctgtttccaacttactaaccatgccaaaaatagtttggaatgaccaatttagttcatagcagagaatggacaccatacctccctatttatggaaaagatactggattttttcctcccaaaagacattatgaaatgtagatttttcattttgtgttgcaaaatttaatcaagtattaaattttagtatattttcttttttataatcatggattttacatcattttaatttttttttgaagaaagttgtctttgtttatgtatatacattatccggttgtcaatcaaggtaggtgtattcaaatctaaagccctcagaagatgcctggctgcttttctaacatgtcacaacctacaatccctggtaatacagagaattcagaggaaaatatgagatatctctctgtacacttatctaaaggagtagatgaagcatatttagtatgtgcttattataattttgtgtggttcgaacatatcacagctagcagtagtaataaaaaatacctttttatagagtatttcttatgttacaataagttaagtacttttctgatatgatagtccttaaaattctcaaatacccttatgaggtgtagacatatttaccctaagagaaagttgaagattataaaggttagagaagtttgtaaagatcagaactgggtatggaattcaggcctgtctgataccaaaatcatggatcttaagtaatttcatatatacaatttttatgtatctactttttctctgcttttctattaaggtaattttaaatgggaacaacttaatggtttaataatctgtgttacatagaattttccctagtatagatttttgataaaatttctcctttactgtttgtcctttaaactcaggcatatctgagcatttatgaaatatcatcaaatagggatcatttagaagcaaaactgaaccactaaactggttaaagtatccaactttcttgtgtattttaataaaacacaaatataggtcaggtgtggtggctcgtgcctgtaatcccagcactttgggaggctgggggtgggtggatcacgaggtcgggagatcgagaccatcctggctaacacggtggaaccccatctctactaaaaatacaaaaaataagccgggcatggtggcgggcacctgtagtcccagctactcaggaggctgaggcaggagaatggtgtgaacgtgggaggtggagtttgcagtgagccaagatcgtgccactgcactctagcctgggtgacagagcaagactccgtctcaaaaaaacaaaacaaaacaaaacaaaacacaaatatagcaatctctattaaacagtcttgatggcaagcatatgctgtaagtaaataactagtaacaggctttcaaaattgaaagtgacagcttttaaaataatgatttcctctaaactgcttgtctgtaattatttttaagatattacataggggactaattaggtacaagataccaaaagggataagaacaggaacaagattgattaattgaacttacgaaagttcctgggaataaaaaatgaattagattgggaagaactgactacgagacttgtgttctgaataatgattaaaaagaatgacaagctaaatttatgtttcttatctctgaatcataaaattctgtttttgcttttgcattgaagcaatgtgtacattaaattgaaatgcatgccttataaaatgtaaacattaacaaaattagggaatatttaagaataaattaaattttaaattgtgaagataaaaccaagaaatcttctacctacttaattcccatgttttcttccacatacaagccctttattatttatttggcactagctatagttattgttggcccaagttaactattatccaacatactttctttagtcataatttttctggagtatctgcaacatttgatgtttcagccatttttgacttttcttgaaaccctcttctcctttggctaacaggtcatcactacataaattgtactcattttttccactggtctcttaaatggctattcttttcctctcattcactaaatggaagagtttttctcaaactcagtctttcatttttctctcttgacagcctcagaaagacaaatgagatggggcctcaagggacaataatttttttttcttttgacagcttaatttggtcattgtgagaggttacagcctgctggcagccctcgcagccctcgcttgatctcagcacctcctcagccttggcgcccactctggccgcgcttgaggagcccttcagcccgcggctgcactgtgggagcccctctctgggctggccaaggccggagccagctccctctgcttgcggggaggtgtggagggagaggcgcaggcgggaaccggggctgcatgtggcgctcgcgagccagcgtgagttccggtgggcatgggcttggtggactccgcactcagagcggccggctggcaccgtgggccccaggcagtgaggggcttagcacccaggccagcagctgcggagggtgcaccgggtcccccagcagtgcaggcctgccagtgctgcactcaaattctcactgggcctcagctgcctccctgcggggcaaggcttgggacctgcagcccgccatgctggagtgtccccccgccgtgggctcctgtgcagcctgagcctccccaacgagcaccaccccctgctctgtggcacctggtcccatcaaccgcccaagggctgaggagtgcgggtgcacagcgccggactggcgggcagctccgcctgcggccccagtgcaggatccactaggtgaagccagctgggctcctgagtctagtggggacttggagaacctttacgtttagctaagggattgtaaatacactaatcagcactctgtatctagctcaaggtttgtaaatgcaccaatcaacactctgtatctacctaatctggtggggacttggagaacctttatgtctagctaagggactgtaaatacaccaaatcagcactctgtgtctagctcaaggtttgtaaacacatcaatcagtaccctgtgtctagctcaaggtttgtaaatgcaccaatcagtgctctggggttttggagaacttttgcgtctagctcagggattgtaaacgcaccaatcagcaccctgtcaaaacagaccaatcagctctctgtaaaacagaccaatcagctctctgtaaaatgtaccaatcagcaggatgtgggtggggccacatgagggaataaaagcagactgccccagctagctgtggcaaccagctggggtcctcttccacactgtggaagcttcattctttcactctttggaataaatcttgctgctgctcactctttggttccacgctgcctttatgaactgtaacactcaccgcgaaggtctgcagcttcactcctgaggccagcgagaccacgaacccactgggtagaatgaacaactcctgatgggaggaacgaataaccccagacatgccaccttaagagctgtaacgcttaccgcgaaggtctgcagtttcactcctgaagccagcgggaccacgaacccaccagaaggaagaaactccgaacacgcccgaacatcagaaggaaagaactccagacgcaccatcttttagaaccctaacactcaccgcgagggtccgcggcttcattcttgaagtcagtgagaccaagaacccaccaattccagacacagttggatctgagttagcagaatggatctaaacagcatttctccctgatacaagcttcactagctcatctcctcttaaagagatcattgcctcgacagggaatctcctatcattacactgccagtggatttttgtttgcctttatttccatatttcctttatatttgtagagtaatagtgtttccagtccctggtttctagtcttgagccctttctatggtgtgttcagatgtgtgcaaattaagtttttttctttgtgcttatgggaggtcaagagatactttttcctttgatgctttctttgcctggttttctcacttaagcctcattattttacatttgtaccacgtgagactagcgacgcttggcataacaattccttgacttaagtactcatgctatatgattttttttcaaaacctacctgtcagtcttgaacacctttggaagtccagttccttgtttcctgcaagtttttatttagatcttattcatgtcacccaagatcaaaagtataaaatcatccttgatttcttcctttctctttataaccagtcatcaagtcctaccaacttctcttttgcagttgtcctatattttcctcctctcactggcccaatcctagttctagtttgggactggcctatttatccaattctttttagcattcattctatctctctccaagctattctacatactgagctaactttctcatgttaattccctgctttaagaaacaaaacaaaacaaaaaactgcaagcagttaatcttcctatcagtatttcaaatagttgtgaagaaacaacaacaacaataaaaacagtaaatattcagatttccattttccatttccagatatcttaattaagtaggtttggaaaagagatcacaaaaatatgtattattaaacgagtatctcaggtaattatcaccaggtagttcaaacagttgctttatgagaaacactattttatgattcttttacttatctacttcctttttctcttcactaacttttgtttaccactagggcaattcactgtcttctgaagccactttcaaccaattgccaattagaagaattttaaatttatacaaccaagctgcacctcaaccaccttgggcacatgttctaggatctgagggctgtgtcaagggccatggtcactcatatttggctcagaataaattgcttcaaatgttttgcagagttcgaggtttttcactgacaaagctactctaatttcaaatcatgcatgtctatgtctcttgtatatcaattagtcatgtacttcatgctactacttattgtttatacctatgttatagcttctccaccaggatagaaacttctttaaagcgctaatctcaccttgtggatacgtatccccttacagcacttagaacaaatatgtgatatatatttgttaatttaacatacttttcattatctctgtagcacaaaaataatgtttcaggggccatgtgacaaaaaaacagaatcatattagatgtgcctcaaaaataaagggaacagagttgttgaaagtgaaataataacttaaaaagtactagtctgtttggaagttttgtttatatgtaaatgcaagtgtgtgtgtgtgtgtgtgtgtgaatgttaacattagtcaaagagtaagaagaattacaaggggacccacaaaacctttaccaatccatgtaatgttgtcaaagataataagtaatatctaatttcaaaatcaaaggagcattgtcccagtcattctttaccacttttaccttttaccttggaatacactaaattccattgtttgcccatgtatctattattttattaccactttatatgtttaactcatcaaatgttcttgcaaatctgatacaattcacaattcactgtgaagaattataaaattatactgttattaattagtccaggtcaaaatcagatccattttggacaaaatcaatcatgaaaatatatggttaattataatgtgatcttttatataaacgataaatatcaaaaaggtggagtagtacaacaatagatattataacagcgtttctttgaaagcattagaacatggcatcaaacataatttactagacaaattctgtattgtgcaggaaaaggagtatttactattttctgaaatacatctttcatcttcatagtgttatctatactattctcttctttgggatctatctcacatttttatcttctctgctatcatccacacagcacctgtgataaaatctgggacaaaataaaattgaataatactacatctttttatttgaggagaactcacaggccagatgtatttgttcttgtatgacagggacaatgaatgattaagcaaagtctcaaaaatgagatgacctttaaactgacccttgtagaataattgagttgatctgaaaaacaatgtagaaaggacattttaaaaagagagacttgtgcaagcaaagacatttaggtatagacattccttgaggttaagtgaaaagaatgcaatgaatatagaaattcagaaaagcagttacataggatatgcccagtagaacttcagagactggtgaagttgagacaatgaaaccttctgaatgttcactcctatgtacatcttttctatatggcacttttccccatatttctttttattatgtaagcataatgctgaatttattttcgtctatttaatgagaagctttttttttcttctttcgatagtcaaccagtaagatcagctacttgttaaagttgggaaaataaatattttactaacagaaaaaattgcattatccataagtgataaaaataaataaaaaccaatctaataactatgctaaatctttagcaagttattactttaagtgcagacctgaccttgattatattacaacagaatggggatagccaatgcctacaaccataatcaataatgaagaattaattctgataatttccctcatatctatcaatgttaaactacattttatgcttatgttattcatgtagttgcatctgttttctatttctgcaaaggttgttatttctgtaacataagtgacttaatagattccagttcttctgtgcatagtttcatttgcatttaatagggcttagtgtgcctctactgaaataggagtttttctaaagcaagaggtttagagtgactgttgtatcactttggggcctcattattaatcagtaattaatactctctggaaagcataagtttgccaaaatatttggcattcaatgaatggcattttgaatcccaatttaaatttggactaaaaaggcttagaaaaaaaatctaaattatttactatattaattataagtacgtttccaagaatgaagaaaactgtatcttctctctttagttccaggcttattcttaggtataagaaggagaactattttatgcattcctagattcttaaatattttaattttgcttgcccatggcagcaatatgtttccgtcatgaaatatatattttttctcatatatgcagaaatgtaatatttttctattttgaaaagtctgattatatatcattgtcatcagttcagcaaaccaatttgggatcaatggaagagcactgcctcaatgcatttggtttcagaaatgtattaataatagtgtataccatgtttcaaatcacatttccaaggaaacctattgtgcacaatgcaattttttcttggacagacaattttatgctatgagtccactggaatacatttttgtttcattgaaaatataattttttcaaccatatatttatataagatgcctaaaatttctgaaagaaaaaatgctgttaatgatattatcgtgttaattttcataaactcctctccatattttaaagtaatacattattaatatagtttctaaaacagtggccatatatttgtactataaatataaggctatgatcattcctgggattttaggactaaaaaataatatgtgacaggctacaatattgttacccaagttatagcagggatacttttgttttaagtcagtcaatcataggtaaagagtcattagcattatttgtcacagaccttctgttagaaaccacaaaagtcagaagaatgaaatgtattacaagcttgtaccctacagctaaaacataaaatgaaatcaatagcatttgagttgttttaccctcagtttaaagtttatcttaattgtcttgtaatttattcctgattgaaagtctagttattgaatcaaaacacaatgacatatttatagaaagctatggctttcttttttcatgtttaaagataattataattttaccataaagcaaaaattgccacttcaattatggagttacataaatcaatctgtgctgtaaacttgcatgttactgcttttgctctacataaaagaatgggaatgactctgtggcacaaatattaacataagcttctatagatgttctgggtacaggcttcttgaagcttctttgggaccaagtaacattatatcctaaaaacccaggagagtttgagtttttctgcaaagaaagagactatggataggaagaaaagatgactcataattttgaaataatgtattagaaatagcaacgcattcggctgggcgcggtggttcacgcctgtaatcccagcactttgggaggccgaggcgggcagatcacgaggtcaggagatcgagatcatcctggctaacatggtgaaacctcgtctctactacaaataaaaaaaattagccaggcgtggtgtcaggcacctgtagttccagctactcgggaggctgaggcaggagaatggcatgaacctgggaggcggagcttgcaacgagctgagaccgtgccactgtactccagcctgggtgacagagtgagactccctctcaaaaaaaaaaaaaaaaaaaaaaaaaaaaagaaatagcaacgcattcacatttgtctttccttttgaaactagtccaacagtcccacagacagttgttttcagataaacacagagattggctcttctgctgctaaagcttaaaacttttatttgttttatctgagctctttcctcagcaaaggaggaccttcaggcctctgaaaaaagtttcagttatttgaaacttaccagatcactgccccagaggcctccttgctcctccccagttcttgttttcttacactcttacgtttcttccctactacataaaccccctagctttagtcaatcagggagatggatttgaaactgaactcccatctcctcagcttcaacacccgattaaagccttcttccttggcaatacttgttttctcagtaattggctttctgtacagcaagcagcaggacctagaccaaactcctggtgtttcattaacactttgtaaaaggaagataattatttgatcaaattagtggtcaatatgggagtaaaggaagaaaatacggatgcttaacagaatgagacaggaagaagagataaaatgtagggagtctagagggccagaaagtttgagtgcaggaagaatgaaaaatcaacacctaatttctaactgaattgaagagagagaaaactccaaagcttttcagattccctgcaatttcaagtactgggaggaagctcctaagcacattcccatgattaaaacagtgtactgtctccatctgtaataatgactaaaccactgttatgaaaaggctgcaaatcaggggtggtgaggtgggagtgggcagaactggagcttagttagcagtcagccatcaggtggattgtatgagtggtatgtatgctacaaatttgcatactgttagcttgatatttaaaacgcttcacaatctggccttaattttccagactcactcatgcattggacaaatctttattgggggtatttatgtgccatgcattttaggctattgggatacatcaataaacaaaacagatacaaacttctgtcgttgcgcagactaaatccattttaacaatatccactaaattctgttctacagtctcactgaaacaatattcttaatatgaaaatatagaattataaaactctattattttctttcatactatctctttaatcctgctaatatgggctaatatctttcctgctgttgaataaaagctcaagaaattttataatttttaaaaaaattgttaatagtactatggtaaaggtaactttaaaaagaatttaaaaatgattctctagttcaatatatgaatctaatactccaaatttcatttaaaggtaaaatgtccttccccagcttagatatgttaatggaagttcctctgcctttggggaagaggctgtaagagatttctttttacttttttctttattaactaccaccacctccttcattcactagcagttgatttttatcactcagacttctattacctgaccttggagattatggagaaaaggcatgtaaggtaggtagcgaagttcctacttcaatattactgttgtgaaatggctgaatactctttgggtcagacctgggtttaaaacagacatggtcaatgagagcatcttcagcactggtatgcttttcttcagcaacttcagtttgccagcatacttcagttaattccagtttgtcattttataggaattctgcggtctatgtccagtttttgccttttgcagtatcatcactccttcaggtaatcctaccgaacaggatttaagaaaactggcattcacctgtgtcccaaatctggtcctttgggttggtttgggtataattatgcaggcaaagaacagtcacaggctctttgcctgcatacttatagaagcacagacctttctagatgtagctgtaatataatgtaatactccagtcattgtaattgcttgttgctctttttctgtctacatttatctgatatgtctcaaacatggatttgctgtgctaggccaacataagggcagcgttttttactgtagttgccaatgttaaacttgagaagggaaagcatatatttccccagccattgtattttggggaaaagtatactgttgaagtgaattcaagtacaactttacaacaaccctcccctataaaggaatactcatacaaagtcacttctaaattttaattcgcgtgaccattttcaattctcctcgagagtaatggtgttcagagtgttaaactctgttactggaacatgatggttttggtctaggttctgctgcttgccacacagatgggcaatcactgagacaatgagtattgctagggaagaaggttttaatccaatcgggtgctgcagctgaggacatgggagatcagtctcatggagacagatccctcatggcttggtgttgtctttgccatagtgagttctcacaagatctggttgttgaaaattgtgtggcaccttcccccaccactctctctctcccttgctactgcttttgccatgggatgtgcctgctctccctttgacttccaccacgattataagcttccggaggtctccatagaaccagagcagatgccagcaccatgcttcctgaagagattacagaaccatgagccaattaaacctcttttctttagaaattacccagtctcaggtatttcttttttttttaaattttattattattatactttaagttttagggtatatgtgcacaacgtgtaggtttgttacacatgtatacatgtgccatgttggtgtgctgcacccattaactcttcaattagcattaggtatatctcctaatgctatccctccccccttcccccaccccacaacagtcccccgtgtgtgatgttccccttctgtgtccatgtgttctcattgttcaattcccacctatgagtgagaacatgtggtgtttggttttttgtccttgtgatagtttgctgagaatgatggtttccagtttcatccatgtccctataaaggacatgaactcatccttttttatggctgtatagtattccatggtgtatatgtgccacattttcttaatccagactatcgttgttggacatttaggttggttccaagtctttgctattgtgaataatgccacaataaacatatgtgtgcatgtgtctttatagcagcatgatttataatcctttgggtatatacccagtaatgggatggctgggtcaaatggtatttctagttctagatccctgaggaatcgccacactgacttccacagtggttgaactagcttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgttttttcttgtaaatttgtttgagttcattgtagattctggatattagccctttgtcagatgagtaggttgcaaaaattctttacagtaatgtgctctaatacaaagagatgagcgagaaaatgatgaaaagataagagaagattcaacacttgtatactaggaatctcccagtgagacagaggagggatagaactttgggttcagatcacctctactagagcattatttcatgcagtcacactagtcaccagaccttgcaccactgtaaggtgatggcagcatcacctcactcatgccatccccactgaccacaagactgtgcaagctataagttacctagagaaactaagatgagggacattctaccatacatcttactcaaggaagttggcccccaatacccacatgcacagaaggctaaaaaaatgactgtggtggcaggcgcctgtagtcccagctactcaggaggctgaggcaggagaatggtgtgaacccaggaggcggtgcttgcagtgagcccagatcacgccactgcactccagcttgggcaacagagtgagactctgtctcaaaaaaaaaaaaaaatcacacggagatgtaacatgttaatgagacgtgtgacacatgaagaagcaagtcatcaaactgtgcaaatgctataaattcccatttctacatgctttaatgtcactcctttcatggctaggcctgttaaaattactctcttggctatctccagggaggcagcaagagcactttctcttttccgggctgctttccttgtgctccagcataagttccaataacgcctggagtctgggaaattttcttagccttctgtcagtttctattgcacaagagcataagaacttgtggccagtaacaccagaatagatgccacattaataaaaaaaaaaaagtctagaattaaaaaaaaaatccctaaatgagacttgaacagttatactacatatatagaaaatgacccagaattgccaacatgtagaaatacattgacaaaaatactgaactctaaagaaaaaataaaggcaattatttggaaattcagaaataagaccagtttgtcattacacatttttttacagtaatgcttcaaagaataagaaaatggaatgaaaaatttaatttaaaaaaagaaaatgagtcaagttatccagtcaaattggtcttcaatgttaaagccctaagataagcttttcttaatgcaccaaaacataggaaatagtgtctctataatcctgcatcaaggactttacttgggaatgggttactgataacaaaatgactgaattgtgttattaagagggataaaacaatatcactttcaattagatgtgtgggaaaatataagagatgaagcagaagcattgctcacaacaggaaacatatgagcagtgcaaaaaaaaagtgtaccatgtaatgtaaaagtaagtcgtagaacaaatgtgggcaaactacagccctttggtcaaatccagcccacagacagcctgttttagtaaaatgaattttatgggagcatagccaaaccctttggtttacgtattatctcttcttgcttttaagctacagcagagtagagtagttccgacagagaccatatgacccagaaaactaaacatatttgtcatctcagtattcccattttgagtatgatagtgaatcaactcattattttgaaaatcaataataaaaggaaagaataaagtttttttttcttgtttttcctatagttggtggacctcagggttactgagtatttgctatggagacgtttttctttataaaaatattttggctaatgaatatagaagtaataaaaataaaaaaataatggatttagaaaattactattggtggttgctactatctatatcacaaaaagagaatcaaagagatttaatgtttaaggaaggagtgaatatcacctatgatttatttgtttaaaaacaaaccaaaaataacctggatatgatcaagcctccagatctaactacttatttcctggaaattaaggaagcagaaagaatatgaaatgaccacttggagagacagtcatcaatccaggcttcagaaatgtggtttcttgcacaaataaatatcaaggtgaataaaagagcgtagtggtgaagcctacagattaaaagagacttaacagacctatcaaccaatggcaatgtatagaccttattttgattctgatgtaaataaatgttcaatgtgaactggatatgtttaatatgaactatgtttaataccaactggatatatattgatatcaaataatttgttacttttggcagcagtaatcatgatattttaattgttttaagagtccttaagatatacatatcaaaatatttacagattgaatgttatgactctgacctgcttcaaaataatgcaatagtgggtagttgagagcatagaggaacaactatttcccagggcgtgattatgttgaattagggagttgatacatggaggttcaccgtaatattctctgtaatttttgtatgtttgaaatgttccaagtaaaatgttaaaatatttaaatattcctagtgttaaacttatgaaattagctctaaaattttacattttaattaatttgcatttaaatattaaatctaatcacatcatggttgcacaatttactttgaaaataatttcattaacaaatttttggtaaagaagtcacaataaaatacttctttaatgaattacacttctgatttttattatccttattcaaatgatatgtggtagggcaactaattctgctgcagagatgaatatttagctaactaattaacctcaatttacataatggttgtatttgcataactaatgggctggggattgactataggccattaacagttattaattaatgagattgaattagaaatatatgggtttttatttcaaacttaggaggcaaaggtcaatcataaaaggttaataacaatattcaaagaatcaggcagtaaatattttagcttttagacttcatgcatttctgacaggataattcaggaattggtttcacctctacatgcatactggggcacatggaagtatacacatgtgcattagagaaacttttattagcctcagatttacatgtaaattaaagtaatgggagctagttgtattcacatataagaacttaatgcacctctattcataaaaatcacaggtatcacttgagaaagttctacaacctaaaatttttctttcttaaactgttcatttgtttcaaggaaagagtgcaggtacacttttcaattaatcttcctcatttttgcatttgcaataaaataggttacattatataatttagagttactccaacctttccactcctcatttatccaattcagtttacaattggaagcatcctctatatttttaaaaacataattgcctgtagtttaaagattttagaaactcaaagaattcatctgctatttttaaacaatttaattatgtgagtgatgcataattattgaggacaattcaattcctttaatttcaaagacacctgtataatctgatttttcaaatgatttggttgtatctctacaaggaactgagcagctctctacactgaatcagtaaatgaggttcacgataaatgaaaaggagtgatttctttttatgatcaactgccaaactgatacagaaaattctgtcctgcatcttctgcctgttgctcctgtcttgctttcttttctctcacactgcctgggttcttgctttatgcctctgccctcttctttttccctcttctcccttctaagaacgctcgcttgctgaaatgccttgaaatgatgtccagggatagtccctgggtgaatgtttcagatcctgtttctcatttcacactctgtctgggcctctattctattaatagttaacttaaactggattatcttgagtcttctagattttaaaagggttgctctgattacaaaaagatgattgcttaaatgcaaaagagtattacctcaatagatgggaaaagaatagcatttattgcattattgataacatctttaaatctgtgtcagttcccttcacaaattggcttttatatgcttctctgtgggggtaaactatatgccacagaaatgttgaagttcggagtcacagaacgtgggcttaaatctgtgacgctttgtttactgtcatttaaaaaaataacctttttaattattaacaaaatcttgcctttgtaaaacagggtagtaattctcatttcatagattaaaagtgtaggttaaaaagtgtaaattaaaaatgaaaaatgatgctacatataaattacaataaatgttagtcgctaattttaagatgattttttcttttctcgaagaaaatatgtaaatacaagaagccacacaattcaggcaatttctagaagtcattcattaaaaatatctatttcccaaggtttatccagagcttcacagtgggactaagttttattatttaacatacacagacaatggtggtattttaacaatattggatacacaatttgaaaacggtgttttattatctcgacatttcaggagtatgaaatcactccctgccttgtcatatattagctgtttaaacgaataggcaatcatctcagagtattaatgatctttctatgttgtccactgagaatgatattttagacataggtatttcatttaaaaaattagcagagacaccatacaattctggtaaaagctttaagtagtataacttactttttgaaggaactcggagattggcaaggaccacttccagggaatcagcttggactcgaagtacatagcttgtcctggtctcataatccagaggtccattcacatagataacacctgtgatgttattaattccaaatgtatctagaaattaaaatacaattacctggtcattgtctttacgctataaggaaagaaattctctttaaaaggcactgtgatttcaaaaacactaaaaatgcctatttataactagagtgatgcatgaaagtgacaaaatgctggcttttggaaactgttccagctctttgaatgatcaacatcaatacttcgctaaagtctgccttgaaattgtagggtttttttgtttttgttgttttgagataatcctggaaaacaaagttctatggtcaattacatttgggaaacactgaataatatattctttaccttagattcagatggtcttctgtcacactaaaggctttcagaagttgtttcaaagaaaaccatctaattttgtttaaccaaaattttctgaacttactggattattatactctttgtaatttatgaatattattattttgtagatttagtgttttgctaagaacacttgagagaaaataaaaaaatggataatttaatgttgccctgtgtctgtttatttaaataaatttgaatgaaaatcagggcactttggtaaactttataatatctccccctcttatgctctccatattctctccttactttattttttcatgtaattaataatcccttataatactatatatttctttgtttaataatttttattattaatctccgcttactggaccattaacttccatgagggcaggaatctattttgtacattgttctatctgtagtggctagaagagtagttaatacataatagatgctcagtacatatttgttgaataaataaataaatgtacaacagtcactgtgggggacagacgttaataaatatagccactctgctgtcttcaaagaaaaggacaaatagaatcaaaagagaaagtttcgggacggaacaggttgagaaatcatagctttagtcagatgttcgaagtccaaggaaaaaggaaatttagttatttttagggaggacacatagtagcacagtaataatgtagaaagaaaggcaataaaagtaagatattgaccacttgctacactacacgggcagcaatacctagtaatagtttgtcattaaaaagcttaacagggcctttataatttccttgcaaactcttttacattcactcatttctttaatatttactattgattaacttattacatgtatattaactatttcctgactacctacaatatactaggctatctaacataccaaaagggaaaacagaggagaacttgtggagaacaggtaaaacaaaaattaatgcgaaagattgagctatgaccttattcccagaggcctgcaaattcctatgattcttaaattacaaaaacttatatttttatttttaatcatgaattgtatgtctaatttgactattttgggaatcatataacatgcatagcttttaacatggatgtgactctttttaaaattcacaacttatttacaaccttgaagttccttcaggattagttaaggtatgaccaacatggagtaagggtcatggatggttcagacactggggcggacgaagctactgtaggcaatgatcatggccaaaagctgaaaatttcatgatgcattaattttgaggaaatgtcattaaaatattaccaaatgaggaaaagggcaaggtttcattaattagatacttaatatttcttaaggtacttaatatttcttaagggaaaaaatcactttagctaacatcactggatttttaatcgagttcaggatacatggttaacaattacatttaagatgggcacaattttattagaaaacaatagaatagataataatttcaattcaatctgaaattaggccaaatctaagtttactggttgatggtgagaacacaaactaaaagtctactcaccttcttcatttcctgaaacaatggagtacacaatactttgattaatggcagcagcagaaattacaccaaccatggtccctttggtggcaagttcacttactggaggaggtctgcaggtttagagaagatgatgtatttatttttaaatataatttttgatgtaactttacgttcacagaaaaattgagagaaagataagagatttctgatataccctctgccctcacacattcatggcctcctccatgatcaaatcccccacccaactgctacctttgtgataaatgatgaacctacattgacccattatcactgaaagtccatcatttacatgagggtgcatattgttgttgtacattttatgagtttggacaaatgtgtaatggcatgtatccgctttcatgtagtatcatatagggtattctcactgttctgaaaatcctctgtgccctgtatattcatccctcccctcaactcaacctctggcaaccactgatctttgtagtgtctctatggttttgccttttccagaatgttgtatagctggaatcacacagtatgtaaccttttcagattgccttctttcacttagtaatatgcatttaatgctcctcaacatctatggcttgattgcttatttcatttttagcactacataatatttcgcggtctgaatgtacccacagtttatttccataaataaaaaacatcttggttgcttccaagttttggcaattatgactaaagccactataaacatctgtgtgtaggtttttgtgactctaagatttcaactcttctgggtaaatactaattagcatgattactggattttatagtaagactgtttagtcttttaagcaactgccaaactgtcttccaaactgactgtaccattttgtattctcaccaacaataaatgagagttgctgttgccccatattctaaccagcttttggtgctgtcaatagtctggatttcagacattctaataggtgtgtggtggtatttatttttatttttttatccatatttatgacagagttttgaacttaatagaagaatgtacacggtagttcttccaagctacattatgcaattacattgtgctttcattgaaaccttttacaaaaaatcctgaaatacaaatttagtctgaagtataggctttataaatatctggtccaaattgctttgtttttggtactgctgtccatacacttaattgactaggttatctaaatgtaaagcagtctttctcacagatactctagcacctaatggtggtccatatattcattgcatgagcaataactgcttcttgctgaagaataagaaccaatctgtatcattttaaaatgaagtgtgtaaagtagatatttaatttactagtttatttacttacttattttactgtcctgcattttctttttgctttcttttgataacatccaaatattgttttcaataatcttgcctctttccttctctgtacaagtgctttgggtaaggctttgccaatccccatggtacatgcataagcacattaaccaactctggtcaatgggggcattttatcctttgctcagtgttcatgtgatgtatacgtctcatgtaaattcaatggacatactacataagattatgacttgactagattctcgctagccaactttttgggtatatccctcactggatttgatgaagtaagctgccatatggagcagtcctcgtggcaagaaactcaaggtgatggctgactaacagccagcaaggaatcgaggcccttagtccaacatcccacaagaaactgatttctgccaacaaccacatgtacttggaagtggatctttctgcagttgagcctcagatgagaccgtagccctggatgacaccttgattaaaagattatgtaagtccaaaaaggagaggacacagctaacccatgcctggattcctgacctataggaaattcaaaatgatatatgtgttgttttaacccattaagttcatggtaatattattatgccacaacacaaaactaatatttgaacaatggattgttaatttatgacagatcaagatacatactacttatcaaaagtttaatacaagaaaatatgtcagtcatattaggggataattttcaaaaactgaattcctatttgtggaagtagacattacttaaattgtttacttgtctatcttgttactgcacaagatagaagctaaattttatactttccataattcatctgtttgctattccttatacagtatggaaacaagacgtctgcaacttatgcacctttagctttaacatgagaaaaatgctatgtcgggccgggcgcggtggctcactcctgtaatcccagcacttttggaggctgagccgggtgaatcccctgaggtcaggagttcaagaccagcctcaccaatatctctactaaaaatataaaaattagccggttgtggtggtgtgctcctatagtcccagctactcgggaggatgagacatgagaattgcttgaacctgggaggcggaggttgcaatgagccaagatcacgccactgcactacagtctgggcaacagagcgagtttaaatctcaaaaaaacaaaaacaaacaaacaaacaaaaaaaacaaaacagaaaagaaaaatgctatgtcttctttcaaatattaaaaaatgcacgtgtacatttttgctaaccttaactgcacaattaggatagaaataatactaaaaaaagtaattggcataatttaagaagacatttaaatcctatgcataccactaaaagcatttaaaattctatttgttagtaaatgtttacaacagatttacttctagacaaaatttctcctcattaacctttgtcttaattgttccagtacacttgtttctatcagaactaaaacactatacaaatacaatcttctcccaaaaagaattaaatgaacctccatgataatgagcattagattaaaaatatcaattattttctattttttggcaggattacaatgtacaatattaataaaaataatattattttattattgttttaggttgtggaaagtaccagttacatgatggaggcaaattgcatactctctttggagtcacatatgtcttgaatacaaatgatggagttggtataaatcaggattcattaagccagatggacagagaaggtaggaacataaccaaattgaataaaatgggctgaatataaattaatagggagaggaatggaagttaggaatgagagagtatgtaactactgtacaataattcaagtctggtgtgatttgtaaatcaataaaggaaattgaaaattttgtatatgtttatgaacgatcaatgggaatttatttttttaaagcatcaatgactacatttgatctatgggctgtcagtttacgatttttaaagcagattaactatctctaatgtcttttctagttctaccattctgaacctgatataatgtgagttatcattcactcttctttctgttgagtataatcaaaatctattgctcaatttcagaagcaatgaattatggccaaatgaaacatttctcagaaggttttctaaaaaaatattttctctattaaattcataaatcttcaattcatccatttatgaaaaaaatgcatcactagctctcttccaatttaagcttttcgcacctgatttataacaaataattgtgagtgtctgaaatggaagaatactatctttcaaagctaaatttactgccaatacaactgacaaactgcactcttaaaagaaacacttgaaacagcttcagtaatggaactatacagcttactgatgtagcttgagatagataccaactagatggccattttccaaagatggctaagaggatgctaaaggaaatggttatttagcagatatgaactggaacatgggagaggctagtggtttcatgttttcataatggccttcagtaagggcttcctcaaaggccctttcacaaggcttgacctgaattgggtttgatgtccttgcatatccatgatggcagtgttggttcctatttactccacaacggcaatgcttctaactttcttggccgttttaaacaaaatctacaggctttgactaaaattccaaaatcacctcaactaaaactgaaatagaatccgaaataatatttgttttataaatatatttcctcattgttactatttgcattatccttaccttctaaattttacatgtaaaacagctgtgtattttcaaaattaataatatttttgtttttaataaaaatgttattgagaaataaattaagataaaaatactggcacaatgcctatgcatttcagtatatttatacttcctcccagaaaagttcaatggtctcagaattttttgtattcttatttattttttaattggcaaatagaaattttatatacttatggtgtacaacatgatgttttgaaatacgtatacactgtagaatggctaaattaaactaccatttgactacctcacaagtttattagtggtgagaacatgtaaaatctattcccttagcaatgtacaatattgtacattgttgtcaactatggtcaccatgttgtaaaagaaatctcttcaatttattcttctaacagaaattttgtatcttttgacaaatatctccccaatccttcccttcctacccagccccatgtaaccatttttttacgctctactttcatgagttcagctgttttagattccatatatattagctttattagatcactattagaacatgcagtttttttctctgtgcctgatgcattttagttaacataatgtcctccagatttgagacaaatgaacgtatttgagacaaaatagaatactaaagtctaggttcattcacattgtcccaaataaaagaattcccttcatttttaaggctgagtaatatttcattgtatatatatatatatatatatatatatatatatatatatatatatcacattttctttatccattcattcactgatagatattttgtttgactccatatcctattataaataatgctgcaataatcatgggagtgcagatatctcttccaccaatagcctgatttaaaaatggaccaaggagcagaatagatagttccaaaagaagacatacaaatgaccagtaaatatgtgaaaaaaatgttcaatatgagtaatgatcagaaaaataaaagttaaatctacaatgagatatcacctcacatctattagagtaactattaataaatccacttcatataacttgtgtgtgaatatgtctctcaccaggttcaggcactggtaatactgcagcccagaatgcagtggagggaagcatttgagttcctattccggctggttcacatagtgacactgtgtgctatcttccacacggtgagagttttcccttaggatcagttattagtgaacttccttcacactgacctaaaatgtttctgtttttcgtctactcatctcacttttcacctgaacccctggtaaccaatgatctttttactgcctctatatgtttaacttttctagaatgtcacatggatgaaatcatacagtatgtagtttttttggactggcctctttccttatcaatatgtgcttaagtttcctctatgtctttttgtattgtgatatctcatttcactttattgctgaataatattacaatgtattggatgtatcacaaataactgcacttttgtaagaagaaaactgatcaaaataactccaaaatggtttaaagtaaatatttgcagattaaatgcaaaccgaaaaagttaactgctttggaattcgcatgcacaatacttacaatataacctcatgaagatataaactaattcatacatatcctttttgttttgtttagacggagtctcgctctatcgcccagactggagtgcagtggcgcgatctcggctcactgcaacctgtggctcccacgttcaagcaattctctgcctcagcctcctgagtagctgggattacaggcgcccaccaccacacctggctaattttttgtatttttagtagagatgaggtttcaccaccttggccaggctggtcttgaactcctgacctcatgatccacccatctcggcctctcaaagtgcaggattacaggtgtgaaccaccgcacctggcccatatatatccttttaatatttctaagtgttttttgaaaatatagattacaataaatctttcaactgagtatatattaactaattttctgaataatgactatagtagaataacataatttgcaatgtctaaatgttagacccagtttttaccgtataaatatagatgaaacaattacaatttaaaatctacttttattgttgagttcaagaagtaacaataaaagtaaatgttgtatgtgtcaaataaagcttctaattattttaaaagccaggcaatttaggatataaaagtgtttgtaaatagatgctataaaatttcactaggattcaatctggctctattgctttctttgtactaagagacaaatctaatttattttgacatgtttgagttcaatatatttgcaaatcagtaccaattaagatactgtttttctacctactatgagaggatttaataaaaatgggaagggaagaataaaaaaaaaacacccactagaactccgattatttataatcttggagtaattgcatcagagtgatctaattttacatatttaaataagaaaaacagtttaaaaaagacatgaatcaggagagagatgctagttcttccagaatacttaggatggattttagataagaaaattaatgaagggccaaaagactagacactgctttttacgtatgttccaaagaatgcgtgctttctgtcactaagagttttgcttctattcagttccttaaagaatcttcatctggaggatacaaaaactgaagtataaacaatttatccaaatatttgaaagcaaaaactgcaatctaaggtgtttggtttttcctttgcttaaattattatattgttctcattaaaatagtgtgttctaatctctcatagtcattggctcttaaagcttaaatccataagaatgcgctggagaaattttttaaacttactaaagtacagaagatccctgatttatgatggtttgactttcggttttttactttactatgggtatgaaagtaatatacattcagtatgctcctggacttacaacggggttaggtcctgataaacccatccctgtttgtctactgccctaccttaattattatagagggcccttctcactctcaaaagtgccctgctttggacaataaattatatggtcttacctatgctggaaactatatggatatattaaagtagcaaatttattcctctcgcttgaaaatttacaatttttttttagtgagaccgagtgtacaggtaatcagaattctgttttgaattatacattatttgacattaatatagtaatttctgctttcccttgtttgtaattgccagatatacattttctgttcactctatttttgtgcatgtgattttggtttaagtacattacttaatggcataaaatcatgtgtgaaaagtttaccagaggtaaaaagcattcttagaagattaagtaaatggcacagctattaagcaccggaggagttgggaaatgaatgacttatccattataaattggtgataaaaatgtgatgattttgaatcaagatttaaatagtataaaattctactttccatggagattgtggaagcacaaagtgacttccattaagaggatatgcatatgtcatttgcctgtttaacaccattcaatgtcttcaaatttctctgtgataatgaacaaagtttttagtatgactcagtaagtcccttcacagtccaactctccctacttctccagactcatcaccataggactccatttagtatgctattttgtctcaaatatgtttgcattgattactaataaaataaaattaatgtatcctactgtatgttttacttggatcaaaatttcccatagatacaatacaatgaaataatgggacgtataaaatcactctttgtattgaaaagtttgtgctaaattctaaacagtggatgtaagttgaactgtttggacttgagtcctttgttgaaggaagacttgcttcactctgctacatgagcaaatgccaaaatgtgtataaccttggaaatgtgaaagagaaattaaattccatgtaggtgcacagggaacctatcaaaactgtaatgaaagattgtcagaatcattttgtcaatagttaaatgggcgaaacctattatgtttgaggcaaggttttaatagtgccataaaaagacaggaaaggctatcttcaggtaaagccagctcttacattggacaacaaatctaaattaaaatagaaaacaattttagcaatcgagttatgctctctgcatatgcatttgttttacattattttaatagtcttcagacagctttcattaacttatttgcaatcaagacaaatcattctttccaaactattgttcatcttattaaaatcttttctcaaaatctgtaagtccaaacttggaaggttttataagaatgatagcctgggcaatatagcaagacactgtcactacaaaataattaaaaaaaaaattagctgggcatggtggcatgcacctaaagtcgcagctacttaggaggctgagggctgagatggaagattgcttgcagtgagctatgaccgagccattgcaccacagcctggaagacagaatgagatcttgtctctaaaaagaaaaaaaaaatgatggctatgttcctcaacataaggtaattttaattctctttaataatgaaatgttaactagacctgctcacttgctatttctttggccactgtgataatattacttgcattttcatagtttacaaaaatgaatgccttgattataaattatactttttctgttttgtatatcaagaggtataatgctaatcctttgttaaatatactctaattttattctttaatataaagcttcttgagaaacttattttaagtataaattgtgtaaaactttcaacctgtcatttattacaaaactaattcgtatgaatcaaccaactagcaattttttattttaacagagaaagtggtaagattatcttttgaagaagagttaaagtttttcaaaatttcagaatgttcacatgtataatattctgattttgaatttgatatattaaattttaataataatagaaattgaaaaggacttatagtatattctctgagtttagcaatatatcaacttaagaggttaacaaatataacttagggatatttgcccttattttattatatatataccagtataaattttgaatttaggttgttatggaaattacacttgcaaatatacaaatcttaaaaattaacatgaatgtgacactaaatcatgcaatggttaatattcaagttgatacatttccatttttaaataaaaaacaaaggcctacctatataggtggcatatatctttgaaaattttgcaattaattgtatttggcaaattttttgataaattgtgtaatataatgcatttcccactcaaaatcaatattcacatttagactctatgatctattccagacgtgttgaccttttcatgatatttacttttaaaactgatgacaagtgaatttcagtgtgtataagtcttagtccatcatcctgaaatgaaggtcaaatgtcattctcattcttcagaaggctaacttacttcacctatgggagtcaatgtaatctcaagtagtatgtgtttgaactactattaggattttgctatttctgtagggtttaaatgaaagatatataaaaggaatttaatgactctgacattgtaactaatttctaaaatatataaagagataattgaccgaaaatctcttagtaaatatgaacatgcagtgacaatgagagtatgcctctcagatcttcaactacaggaagcacaattggtcaaggtcccagttactgtggactgaaatctgtttatgtttgtatgaaggacatagttcctaagggctgcttaaggagtcaagtattgaaatgattattaggccaactaaatgatctctatagtctatttcattcattgcataatgtgaatttgagaaaagaatttttatgaataagattaacacatttttctcaatttctaatgaaaaacaaattgtagaaaatgatttaaacaaagatatgcaattgtaaatagatatgaagaaactacctaatcacttgaatggttaaaaaatcaaagtttataattggaatatttctgtgtaatagggatattacccggacttaattcatttccctcccacccccaccaaaaaatgaagctagttggagataattttgagaaagagaggtggaggatgtttcaacaataaagaatgaagaaatgccattagctttttaagaactctttgtttagctctttgttcaaggaaagatagtagagcaagaaggaagaatgatcacatggggcatgcaaattctaagacactaatatcattgttatatctttgtcaaaaatagaaactgaaggaaccaaataaaagagaaacaatgcatgtggaagatttgttacaatttgagatttttggtcgtgtgtatgcttctaaaatatacaaacgtttgtttacagttgtagaaaatgtcacaggatccttgggatgttgcttttccagtaggaagcctctgtggctggtggcacctttacatgaatttttttcaggcctactgggcttgtttcacccactcagcctggcaggcttcacttggcttcttctaccggcccagatcccatgcctgccaagggtgagccaggtgcagagcagcaaggtggggatgagagtgagtgtggggtccaccactgtgcacagccaggcacgctggctgctgtggtgggaagggtggccccaggtgccagcacagatgccagctccatacaagccagtggctggatctggtgcactgcaagcagattccactgaaggcacccatgtctggatgaggagaacgtggtggcacccagtagattggagacaacagaaaccagagtcccaaagacggtgtcatagccctggctcagggagctcctaggtctgggatccctgaagggccacttcgcttctcttctctccttctcattgcccacaatgtggcaagcggggaggcatgtttcagccctgctggtattactgctctttcagtcctgccattcagcaggtcccaagttcttgtcccacatctaggaagaattaggtatatagccatctgaagggtgagcaaggcaaagaggtgcttcattgagcaacagtacatctctcaggagacctgaaataggcagctcctatatgcaggcaggctgtcccgatgtctgcagccctcagtggcgaggagacccagagtgggtagctcctatcctcaagcaggttgtcctgatgtctgcctgagtctggttgagactggggtttttatgggcttcagaagggagaaagtgatattgctgattggtccatgggcagccatgggcagccataggcagcctggagaaagcaccataagttctcactccagtccagggaactggcaggctgggcaccagccttcaggcaatccttggctagaaggtggggtttcaccagacccatccctttccacccaggagcctgtctgccttctgctgccattcatggcacccaggctgtttgtgcccaagaggttcctgcaggcccgctccaggccacccccagccccaccttggcttctctcccatgctcattggtgcccaaagtccagagtgggctgaggtggcaaggggctggtatgtcagcaccacatgagtgtgggaacacacagccaggtggtgacaatgctcggggcttgatgacagctttgctctgaaattggagcaggccctggaagcagggagaggccaggcattgggagaacacactttgagcatgcagcaggaggggggcccaggtccacagtctcagctgggtgattgcacctgcacctgagagctctgggctccagcccctccaactcagaagtgggtggggcccctgcctgttctcagctctcactgactctgcagagtgcatagccccagctgtgtttccctggttgcagccagcgtctttgcagcaaatgctccagacaggtcgctgttgtcatcaaaaggaatagtatacagtatgaagagatatatatttcaaaagttttaagaagaactcattgttttctggatagaacaattgatcattaatgacaaatgaagcacacaatgtcttgatcctccatttcacctaagtgactccataaaagattgatgtgaaaaggtcaagaaattaacaaaatgagtctgtttcaattactataacagccctacaaagcaaagagaatcaagtgtatagtaattcttatctactataactctggccattataaaagtaaacatatgaggcaattttcttgccattatgtgattactcctacccttaatgattattgaaagccagccaccaggaaataacatcagttcacaggatttgaaaaaaaaaatcaaatcttttcccaatacatataaaatatcttaatattataaattataaaccagaaaaacatcattttccttgagaaatgtgtttttaaataatgacaacctaatttattttattgagtatagggttgtctttgtaaaattcttcaataattttcaaacttcattaagggagcattagcagaaagtaaagaagtaatttttttgttctgttttgttttgttttgttttgttctgagacgaagtcttgctctgtcacccaggctggagtgcagtggcgcaatctcagctcactgcaagctcagcctcttgggttcatgccattcttctgcctcagcctcatgagtagctgggactatgggcacccgccaccatgcctggctaatttttttgtatttttagtagagacagggtttcaccgtgttagccaggatggtctcaatctcctgacctcgtgatccgcccatctaggcctcccaaagtgctgggattacaggtgtgagcaactgcgcccggctgtaaagaagtttttaaatatgcaaatgaaacagaggcagagcatgattaactatgtggaagaaggggctggttttttattatgttgttacttttacataagtcagaaagcctactaattatctgtcatcaaaacttcacaggcaaaccagtaggtttttcctttagtaaatattaaagtacttactgtggtgtttattacttgtgtctattattttgctattttacaattttggaagaagacaatgataggtctattgttatattccagcaactaatcaattaccaatagaacaacatagaagtgctttcaattctaaaaaaagaacaatggattttgtttctctgtctagctagaactggtatactgaaaaacgtatgccaaatagtaaatgcgaactctgaaccatttttgatcaaggtcttcacaatgctagttttcagctcataactcaaatttacactttgccattatgctttcatttttattttctttatattttacttctgtgaccaagacactgcaacttctcagaaaactggagaaagtaattcattgtataaaatattcaacctttagcttgaagtccagaaaggtttggcttggaatatgtaatgttaatactcattaaactgaaatcactaaaaatacagatttttaaaacaaccagaaatgttaatctgagatttgctttgaattaagaaaataaatattcattctcttgatattttaagaacaatttacttcactaacgcatatttaaatgtaaaaatgtttctattctatcattagctcatgtaccccatggtgcattctaactaatcagtcattttaaaatcactgtggcaattaaaatctatgaatctgtaaattgtttacaatcacatgtttaatgtgctaggtcttcacctacaccatttcccctttttcctcaacaactgaggttgaactaggacacagttgcctagcaaggaacagcattcctctcccctagttagagctaaatgtagacccgtacctggattctcacaacgtaatgtgagctgaactgaaatgtgcaattctcacctcacttggttaaggaaatctctagatgtggacttctgtctggtttcccctttctgctgactaaaatggtaataatgagttattttgaaatagagtgttgaagatggtgacccctgagttgtcccaggtccctgaactttaaaccattgatatttggtggtttcctattacagtgacctaaactaccctaactcagtctgattaccctgagatttaatgatttaatgactgtctaatagaaataagtcaacggagtcagtgacagaacggggacgtatgggtcaataattcagttaaacattctacgataaataaatactttatctttaaaatctctcttttatacctaatcatttgttaaatgctaatttttcctatggaattcaaacacaagtattggaacgaagacattcctgagatgtaaaagccatgtgtacctcagcttacagtgctagattactgctttccatttgtaacacattaccttcccctacaccctacaaagaacataaatcttgagctatcatttttatatttcccccaaatttgatcacaagaagtagaagttttttcactaggagcaatcccaacacgaaagaccatcctaataatcaaaaattaataatgtcatttagcatctctgggaataatgtgcatccagttgaggcagtaaaatgaatttgaaaaaattagagaagaatgaggcatatgaggttggcagaaaccattctgtgcttcactttttttcattaagaaaggaaagtgtgttggcctctaaagcagcctgaaatggcataggcatattgccaaagctagcaattgaacatattaaaagaaaataccatacagaaataaaaatattctaccatgaatattttcatatttccatatattcatattttgcaatatgaatgagaatgacttttaaatatgattaattaattatgcgattagttgttggaaactaataaaatgttgaacaacttatattagttgaaacaacagtagctaataggactaagcctgctcaggaaatgatgcagaccacttagttccatatttttttggccagaaatcagtcaaacggcagaattcagaattcatccctagttaataaggagaggaaatgtaatccagctatatgcccgtgagaaaaaggatttaggaggcatccagatactgctatgtatttcctcaatggtcttcaaaaagaatgaagagataattgaagatgataatcattagccttaagtttctttatagttcagttaaaattttggttcaaatttagacctatataaacatttatattcaattatttgcatttatccaaaaagtagtgtccttgttcatatttggcataacatttatttttcaaattttctggttatttgataaaaaattaatccttttaagtactcaagtactactaaatgcattatgatcaagatactgattcttagcatctctgggagttatgtgtgtacagttgtgtatattattaatacacagtaggatgcaacaagattaccaaattctctttataactcagaataacaaatgaactgggataatcaagggcaattttgtaattgttagaattctggaagatcaaaattctcccacatgtacccatgtgactgttgttaattttagtaccatataattggctaacttttgctctctaagttaacaacaactttattaagagaatctatttgtagttaatagttctatgcagagacggtatgaaatggtaaattatacgttgaacaacacattcgcatttttaaaacatggcattaagcaaagatacttaataaagaaagttaaatgagcaatgccctgtttcaatttatgaccttggcctcaatgccacaatattttagctaaaagagaagtctagaggcatatttctattgacaaggaaatgagctctaaatgaaaacctagagaaacagtacaccacttaagtttatttaaagaggaagtttaagcaatatatcactttcttctcttggagtttccaaagataattagacttgccgcaaggggctttgaagaacacagatgggaattttaagttaaaactgtgagcgtttttttggatccacttagaagactaagtatattttttgagaacacctgatctagataatttagtgagaaacaaagtgagtttatatccgtcctgttcttgagaactccaaaattaacatgttcagagaagttcttccaaaacagaaaactgtgcataggagtccccctttatttatgggggatatactccaagacctccactagaagcctggaacttcagatgacaccaaagcctatatttactatgtttttttttttttcctgataacccagacagttactaagtgactgatgggcagcctggatacaatggacaaaggaatgattcagctccagggcagagtgacacaggacagcacaagatttcatcatgatactcagaatgccatacaatttaaaacttacgaattgtttatttctggaattttccacttaatattttctgaccacggttgacctcgggcaacaaactgtgaaaaatgatactgtggataaggaggggactactgtattccatagcaaagaattggaatccaatccaaaggattggaagcacaggttactgtgtcagaaaaaaaaggaaaataatagataataatgtacatgtgggtgagaataaccttttaaaacagattaaacaagaattcttatttgttttacatatggtttacatctcgatgatttacatacatgctatggaagattttctggtaattatattacataatttaattttgtgtagattcttctaaacgcagctttgtatgagaggatgaaactgcttggttcagtgggttaagtgcttgcagatgtatccctcacctaccttattcctcagtaccttagctgctgttctagcttaaaattattaattcattctaagaaagtaaaaaacactaaagtcatcctagaacatgatcaagttctccattacctgaaatattcatttttcattatcctcaattattatcatcatccaactttcaatttttctttggatagactaaactactaaaatattctggaatttaatgtagactcccacaccccttatttatatttctgcataggctgaatatttggtgtggaatatccatctatatctttttggattgactaaactctacatttccttcaatctacaacttaaaactgtgttaatcatgttcaaatatagttaagtgtcccttagcctgcttcctcaatactgtgatcttatttctaccattgtgttctcacagtgtattatatttttcatatagttatttgtttccagagataccagagagcttgctttctctctctctctccagataaggacatggcaaaaaggcagctgcctattaagaccagaagagaccctgaacctgaccatgcagacaccctggtcttaaacttggattgtcagctaccagaacaataagaaaataactttctgttgtggccgggcacagtgcctcacgcctgtaatcccagcactttgggaggctgaggcaggtggatcaggaggtcagagatcgagaccatcctggctaatgcagtgaaaccccacctctactgaaaatacaaaaaattagccaggcatggtggtgggcacctgtagtcccagctactcgggaggctgaggcaggagaatggtgcaaacccaggaggtggagcttgtagtgacccgagattacgtcactgcactccagcctgggcaacagagcaagactccatctcaaaaaaaaaaaaaaaaaaaaaaaaaagaacagaattttctgtcgtttaagccacccaatttatggtattttgttatggctgcctcagttgactaaaacagtatatatactaaccataaactataatatataatattggtgtatatgcatatagtgtatatatataaatgtatatgtattatatatgtgtatatatagtgtgtatatatatatacacacagtatatatataaatttatgtatacacacagtatatataaatacacacactacatttatatatatatatacacactatatatatacacatgcactacatatttacacacacaaacgtacacacatacacacatacacactgattagatggaaaatatgattgcagattgcatgccaaaattggaaattgaatgaaatgttccacctggcaataatgagaaactaaagatctatttctcaccattcagatcattaattagaattgaaaccccaaaatataatgttgtattttaataagtttgcactaattttttaaaaagtatccattattcattaaaccattactaaaacatattttatactaaattgtcatattaaccatttaaaaatttaaactatattttatgttaatttagaaacgcctaaaccaaaattggaagtctactcataaattcatattacatcaattttgagagactcctttcaaaaatgccctaaacatttcgtgtatttcaaaatcggacagaaatcaatacctatattcctcctgtgtgaagcgtgggatctcaccaggatgtaagacaagaatcttcactgtggcactgctggacatcacaggctccccatcatcaaaagcaaccaccaccaacttaaaaagcaataaaaattcatgttaaagattataagtaagaacagcgtaacagcacaatttttatatgtatgtttttacttattggattgcctggttccagaaggggaagcaatgatcatttcctcactgcctaccaggtggcagacactatgctagaaaatactacgttctcacttaatctttacaataatccagccagataaatgttattattttcacttgctagatgagaatactcaaagaagtaactaactctatgattaaaaaacaactaccagtaaaacaagtgtattatactatatctctccaattaaagactcatttctataattccactgaagcccacagtaaatacacatgattttatagcaccaatacacttatttaagaagtgttaaattcagacacataaaaagctaattatcttgctcaaaaaagaaattaattttcctagtgaattagttgtttttgagattatagggcagaaatactttactctagaggataaaattggaaatctttatagtttaacactctttggtatactatctcttaaaaacaaattataaggccaagttcatttggtatagcagaaattgttcaaatgatgaaaactaagaaaaagctttagtgttgagatgtgatgtctgacattatttatcactgcaataggatttataattgattattttctttaataacctacattacatcaaagtaattctatgtttactttaagacatgttaaatactttcagaactatgtgcttctttggaatataaattgttttggaagctgcaggttaacaatgtaaactaattcaacctagatcacagaagactgtaaccaaggatcatcctgagagccacaattgacctttgggttaatgctaatttacaaactgatcagctgttccaaacagcggtaaaatcatgagagacatagtgctcactgatccttacgtggttaactgataaagctatttccctactgtagagtcaaagactttattcacagtgacaaaaattattctaagtaactattaaaaatggaaatgttcaaacacttaataaaattgtctacttatggtaatgcaaattattgttttaataccttgccaggtagagacaggcattattttgtcaaatatatttttaaatatgtaaaaaacaaaagagggaatatgttctgtttcattagtatttgaagaaaagtaaaatttgacaaaaaatcaaatagatacagatattttcctagatatatgcaaagattaacataacaacaatcagtattgagtggtattaggaaaatggatactctcaggaaagatgaagaatgcatacaaggggtatttttttcaaattttctaggattgtaatatatcaatcttatcttaaaaaagtgagtaagggaaaaatgatattcatacaagtagttgcatgatagcatttattgtaacaaaaaatggaaagtctaattataaagcaactcagtattatattaaaaagaaaaacaaaatgttatatagtaaaatactatgaaaccactaaaataatagtattaatgtcacttattggcatagacaacatcatattgaatttaaaaaccagtatgtataagactatgtgatttgaaaacatatatttatatatttgtgtttgtatgaaatgtcatcatgaggatagagatcaaaacgcaaattctagctatttccaagatgtgagataccaagtggttttctttttactatttttgtaagtttctaagagaaaaaaaaattgtaatttaaaaaaattaaaaaggagaaaaattgaaagaaaaaaatgtgctgtcatctgttaagccaaattctctatcaaaaattaaacatcaaatagaccacataatgaaaagagacactgaccttaaaaattgttgtaggttcttcattaagattgactcgtgttattactcttccagaatcttcttccacttcaaaaatactggcagggtaaggaaactgtacatcatctactctatacctcacacgacttgcaggtaatccctaaaataaaattattaattattaatttgctgttaccaagttaaaacacagtgcaatgataatattaaatggatctttaaaattcatggtcttttagaagtgaaaatcatatttccatattttcattctttcagagctgaaatgtagccagatcattatttcttcatgataactcaatctgaatcaatgaagtatctctactacaggttattttaaaatgatttatatgagagaaaaattaatggttgctttgggcatcttctctaccactttcctttaattatgtgaattacatcttcctcccaaaacacccaatatctccttttttaaattcagagacagggtcttcctttgttgcccaggctggagtgcagtggcatcaccatagttccccataacctcaaaacttctggtttcaagtgttcctatcccactttagcctcccaagtagctgggaatacaggtgtgtgcaaccatgcttggctaatttgagaggactgtagtaaagtgcaggaatggacatgaaagctaaaaaaacaaaaattatttaccatctacactgtgttgattaccatgctaggtatttctatacatcattaggttaatgctcaatcttttaagatgacattaataatgaagatgatagtaataatggtaagttaatgacgctaacaattgctagatgcttaccacttgccggaaccacattaaagatgatgtatgtgtactctgttacccattttagagctaaggaacttgtggcttacaataagttaaagagtgctgaaatattccagagataggccaagataagttgggacaccaaacaaagtcacttttaaagaaaacaattaaaatttgataagtttttaaaagaatcaaagtgattgtaaaggaacagtcaaaattttgctggctgtcctcacttatattaggtttcagattggtttcctttggaactatgtagggtgacattgaggtgagcactgtaacatttacagtgcttaggccttgtaaatttcttaaaacctagaagtcaaataaatatcttgagcagagaactagtatgtggtaaagttttacttcaaacctaaacactaaattacaacattaacttcttcagagaaagaaacactcctatttggcattattctgatgaagaagaagtaagaacattaccccccacagggtgttgatttggctggacttgacactttggtgtaaaaactgttctgagaacattgctttttatatttccattttcttcaagactgtccttgaaaataatctgttgctcatgttggttcctgaattacagttgggctatgagataaatatgagttttcaggatttgtataattccctattttctgttagttcagtcctttcatatactacacgtcaccactgatgactgtctccttgaatacattctttatttaacctttttccactattctgccttttctccttcccatctggtgctctgtctcagactctgcttgttcccactctttctggctactaaatgttggagttttccaaggctctgtttcaagaacttctacattttctacttctactctcggcccctggaacctctcccagtctgatagcttcaaatatcttctatttgttcataaatatcaaattttaatatctggctaaactctgaacattttaagtccaaactagtacacataattgtccacagatatgctattttcaaataaatgtattcaaaaccagaatgatttcatctcccaaatttataactcttctactatagataatggctctaccttttactaaggtgttctatctgaaagcctaggggtaatcattgatcctttctcttaagccccatagccaaatcatcatcacatcctgccaatacctcaatgagtataggccctaatgtcttctcatatcctctgtgttttctgtagtagactcttaattgactttctgcttccattgtattaaaattatctcatgactcctgcttaaacccttccaatgattttgcatcacacacaaaaaaaataaatacaaagttgttagtaagggcaatctgatcctaaaaacatttcttttttgcctactcatctgatttcatcttgttcatttccctttcacacattttccttgttcctgcctccttggctttgccaaggcaatagtcctttaccaggaaaataaggtggcaatataatacactcatctctcagatttttggctaataaatttaccttcctcttctccaggcgttctctaatactccctttaaattatctttcttcagcaaccctgtctgaaattatagcatatattttatgtatttacttgtttactgtttgtctcccacataagaatacaagctttattagggtagggactgtagctgagtaccttgaatgttacctgacccataatatgtactcaaggagtatttgaataaataattttttatttataaaaaaatttatttataaattttatttattcataaaatttttataaattttatttattcataaaatttttataaaattttatttattcataaaatttttataaatttatttaaaaattatttataaaaattttatttataaattttatttataaaaaatttatttgcataaataagtgaatggataaccacacatcaagggtgcccagacacttcaactgatatctaaagtattcatatatttgaaggtttgggaaatagagaacattgaataaaccttgaaagcatgttagggaactgccagttctgggataatatttttatataaaccactgatttcacctagtggtggatggtcagttcacccactgaagatttatagaaacaaggacacatttttttagaaaaactttggcctatatggacagaatcagacttattataatcatatacaatggcaaaccttgtatatgatttgcttgtgaaagagtgggggtttagcagaagacatcgtaggacttggggcacagtgtcatgcaatgtcagcaactttgcttgcatttgaataataatgataataacaagagttgttagctatcagtttgagtattttactatgtatcagactgcatgtattacatgcattttcatacctacaataagttcagaagttggtattaatagtacctacatttttttttttttttgagacagagtcttgtactcttacccgggctggagtgcagttgcacgatctccgctcactgcaacctccgcctctcaggttcaagtgattctcctgcctcagcctctcaggcagctgggactacacgagcccgccaccatgcccggctaatttttttctatttttagtagagatagggtttcactatgttggccagccaggtcttaaactcctgacctcatgatccgctcgcctttgccttccaaagggctgagattacaggcgtaagccaccgcgcccagccctactacctatatttttaaaataataaaatctaggctttaagaattatcttctgaaattttcttagctggaaaatgccaaagttattaattgaacaaacttggctcacactaaaaccgaagtcttttaataacaaatcaacttaacatttttcagtactatcttaaaggcaatagtcctttaccaggaaaataaggtggcaatacaattgagcaaaagtgcttggcaaagatactatagaatttgataccctagtaaatctcgccttagaacactttctaagaggttatgcagcacataattcaagtcacctccagaacaggaggtcaatgatgaaagaggataattatagcaccaactgcttcaagaacaaatttttagagtttttgctagcatgaggacccattcagtctgtaggacggtgactaaaattacttatgacaatcagattggctctcaaaaacataaaataagttaattatacttagaatcttctttttaataaagccaaaatttttttttgcatatggaattatgcctgtaattgataaaatgaaaaagaaaacatgctggtattatggaatgttatctctcagatgcctaaaatagtttgctatccagaacatcttagaacttcctggatgatttttacagataagattgtatgtatataaatatgaacatatgactaaaatagtttgctatccagaaaatcttagaacttcctagatgatttttacagataagattgtatgtatacaaatatgaacatacatgttacatagtgactacatcaataaactttttattctaagattgcaattattctatagatataccacaccatcatgaaagtgtggccctgagaggactcatttagcctgcaagaaacattttgattcttttatcacccttgttatcaaagcacattttattttatatcacatattatgataactatactaaataactaaaatgatgtagactttcctctcaaaacatttaaaagtttttttctctctctgtcctttcctaaaatcttccttcccttcttcccttctttttgctttcccttcctccctcctttcctttctttacttctttccaaagtctttttaaaatagttgcataaataagctatataataggtaaaggtaataggctttgggaaacagctctaattcctaatattatttctgggaaatttacaaaatgaatcaagtcaaattcattgttttaagaaattataaaaatagctgtggctttaatcttggaaaaaattgtcattttgaaacccagaatttcaagtactctaaaaaagttataaacttgatcacttaaaattatgaattagcatttattaagtatcttttaatactttattccactaaaatataatagatatgatcgaagtattctaatgtataaaactcacccttattagttatgttttaaaaactaaaataatatagtaaatgagtttatgaattatatattttaattattatatatgtgacaattaaatatttaaataatcattcatatatatatgtatatatattttaaagacaggatcttgtgttgtcacccaggctgatgtgcagtggcatgattatagctcactgcagctcacacaatctttctgcctcagcctcccaagaggcttgatatggtttggctttgtctccacccaaatttcatcttgaattgcagttctcataatccccacatgctgttggagggacctggtgggaggtaacttaaacatgggggcagttaccctcatgctgttcttgggacaatgagtggcttctcacgaaatctgatggttttataaagggcttttcccccttttgcttggcactcctccttgctgctgccatgtgaagaaggatgtgtttgcttccgcttccaccatgactgtaagtttcctgaagtctccccatccctctggaactgtgagtcaactaaaactctttcctttattaactacccagtcttggacagttctttatagccatgtgagaatggattaatacatagctggaactacaggtgcatgccatcatgctgaactaattatttttaattatttgtagagataaggatttctttatgttgcccaggttggtccagaactcctggcctcaagtgttcctttcagtttggcctcccaaagtattaggattacaggtgtaaaccactgcacctggcctagacaaacattaaatttccaaatatttgcttttattttaaattgtattaggaatagacagaagtctcttttatatatacccaataagttaatgtttctttcaattaaatacttcaaataatcatattttttaaagtaaactatagaaaacatttaaaatcaatatgaaaattttaaatattaatttctacttcattcatgataatatagtatgtatattctaccgtatctctctatgcatagctgtatatatgtcaagaggaattttttggaccatgaataatgataaaagctatctatttacaagtaaatcaatatttggaggaggttccaagatggccaaataggaacagctccagtctacagctcccagcgtgagtgatgcagaagacaggtgatttctgcatttccaactgaggtaccgggttcatctcactggggcttgttggacagtgggtgcagcccatggagcagggtggggcattgcctcacctgggaagcacaaggggttgtggaatttcctttcctagacaagggaagccatgacagatggtacctggaaaattggtacactcccactctaatactgcgcttttccaacagtcttagcaaacggcccaccaggagattatatcccacgcctggctcagagggtcccacacccatgaagcctcactcactgctagcatagcagtctgagatcgaactgcaaggcagcagtgaggctaggggaggggcatccaccattgctgaggcttgagtaggtaaacaaagtggacaggaagctcgaaccgggtggagcccaccacagctcaaggaggcctgcctgcctctgtagactccacctctgggggcagggcagagctgaacaaaaggcagcagaaacttctgcagacttcaatatccctgtctgacagctttgaagagagtagtgcttcccccagcacagagtttgagatctaagaacggacagactgcctcctcaagtgggtccctgacccccaagtagcctaactgggagacacatcccagtagaggccgactgacacctcatatagccggacgccactctgagacgaagcttccagaggaaggatcaggcagcaacatttgccattctgcaatgtttgctgttctgcagcctccgctagtgatacccaggcaaacacggtctggagtggacctccagcaactccaacagtccagcagctgacggtcctgactgttagaacgaaaactaacaaacagaaaggatatccacaccaaaaccccatctgtacatcaccatcatcaaagaccaaaggtagataaaaccacaaagatggggagaaaccagagcagaaaagttgaaattctaaaaatcagagcacctcttctcctccaaaggaacacagctcctcactagcaatggaacaaagctggatggagaatgactttgaggagttgagagaagaaggcttcagaccatcagtaataacaaacttctccgagctaaaggaggatgtttgaacccaccacaaagaagctaaaaaccttgaaaaaagattagacaaatggctaactagaataaacagtgtagagaagaccttaaatgacctgatggagctgaaaaccatggcacgagaactatctgaggcatgcacaagcttcagtagccgatttgatcaagtggaagaaagggtatcagtgattgaagatcaaatgaatgaaatgaagtaagaagagaagtttagagaaaaaagaataaaaagaaatgaacaaagcctccaagaaatatggaactatgtgaaaagaccaaatctacatctgattagtgtacctgaaagtgacagtgagaatggaaccaagttggaaaacactctgcaggatattatccaggagaacttccccaacctaacaaggcaggccaacattcaaattcaggaaatacagagaacgccacaaagatactcctcaagaagagcaactccaaggcacatgattgtcagattcaccaaagttgaaatgaaggaaaaaatattaagggcagccagagagaaaggtctggttacccacaaagggaagcccatcagactaaaagtggatctctaagcaaaaaatgtacaagtcagaagagagcaggggacaatattcaacattcttaaagaaaagaattttcaacccagaatttcatatccagccaaactaagcttcataagtgaaggagaaataaaatcctttacagacaaacaaatgctgagatattttgtcaccaccaggcatgccttacaagagctcctaaaaggaagcactaaacatggaaaggaacaaccagtaccagccactgcaaaaacatgccaaattgtaaagaccattgatgctaggaagaaactgcatcaactaacgagcaaaataaccagctaagatcataatgacaggatcaaattcacacgtaacaatattaaccttaaatgtaaatgggctgaatgctccaattaaaagacacagactggcaaactggataaagagtcaagacccatcagtgtgctgtattcaagagacctatcttatgtgcagcgatacacataggctcaaaataaagggatgaagatctaccaagcaaatggaaagcaaaaaaaaaatagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagcacccagattcataaagcaagtccttggagacctacaaagagacttagacttccacacaataataatgggggactttaacaccttcaggtcttcagagcagaactgaaggagacagagaaacaaaaaactcttccaaaaaatcaatgaatccaggagctgtttttttttaaaaaatcaactaaattgatagactgctagcaaggctaataaagaagaaaagagagaagaatcaaatagacacaataaaaaatgataaaggggatattaccactgagcccacagaaatacaaactaccatcagagaatactataaacacctctatgcaaataagctagaaagtctagaagaaatggatgaattcctggacacatacaccctcccaagaataaactaggaagaagttgaatccctgaatagaccaataacaggctctgaaattgaggcaataattaatagcctaccaaccaaaaaaagtccaggaccagatggattcacagccaaattctaccagaggtacaaagtggatctggtactattccttctgaagctattccagtcaatagaaaaagaaggaatcctccctaactcattttatgaagtcagcatcatcctgatactaaagctggcagagacacaacaaaaaaagagaatttaaaccaatatccctgatgaacatcaatgtgaaaatcctaaacaaaatactggaaaaccaaatccagcagcacatcaagaagcttatccaccacaatcaagtgggcctcatccctgggatgcaaggctggttcaacatacgcaaatcaataaacgtaatgcagcatataaacagaaccaaagacaaaaaccacatgattatctcaatagatgcagaaaaggcatttgacaaaattcaacagcccttcctgctaaaaactctcaataaactaggtattgatgtaacctatcttaaaataataagagttatttgtgacaaacccacagccaatatcatactgaatgggcaaaaactggaagcattccctttgaaaactggtacaagacagggatgccctatctcaccactcttattcaacatagtgttggaatttctggctagggcaatcaggcaggagaaagaaataaatgatattcaattaggaaaagaagaagtcaaattgtcccttttttcagatgacatgattgtatatttagacaaccccatcatctcagcccaaaacctccttaagctgataagcaacttcagcaaagtctcaggatacaaaataaatgtgcaaaaatcacaagcattcctatacaccgataacagacaaacagagagctaaatcatgagtgaattcccattcacaattgcttcaaagagaataaaatacctgggaaccctacttacaagggatgtgaaggacctcttcaaggagaactacaaaccacggctcaaggaaataaaagaggacacaaacaaatggaagaacattccatgctcatggatacgaagaatcaataccatgaaaatggtcatactgcccaaggtaatttatagattcaatgccatccccatcaagctaccaatgactttcttcacagaattggaaaaaactactttaaatttcatatggaaccaaaaaagagcccacagccaagacaatcctaagccaaaagaacaaagctggaggtatcacgctacctgacttcaaactatactacaagtctacagtaaccaaaaacagcatgatactggtaccaaaacagagatataggccaatggaacagaacagagccctcagaaataataccacacatttacaaccatctgatctttgacgaatgtgaccaaaacaagaaaaagggaaagcattccctatttaataaatggtgctgggaaaactggctagccatatgtagaaagctgaaactggatcccttccttacaccttatacaaaaattaattcaagatggattaaagacttagatgttagacctaaaaccataaaaactctagaaaaaaacctaggtaataccattcaggacataggcatgtgcaaaggcttcatgactaaaacaccaaaagcaatggcaacaaaagccaaaattgacaaattggatctaattaaactaaagagcttctgcacagcaaaagaaactaccaccagaatgaacaggcaacctacagaatgggagaaaatttttacagtctacccatctgacaaaagggctaatatccagaatctacaaagaacttaaacagatttacaagaaaaaatcaaacaaccccatcaaaaagtgggcaaagcatatgaacagacacttttcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggttctggagaggatgtggagaaacaggaacacttttacactgttggtgggacagtaaactagttcaaccattgtggaagacagtgtggcgattcctcaaggatctagaactagaaataccatttgacccagccatcgcattactgggcatatatgcaaaggattataaatcatgctgctataaagacacatgcacacctatgtttattgtggtactattcacaatagcaaagactttgaacaaacccaaatgtccatcaatgatagaccggattaagaaaatgtggcacatatacaccatggaatactctgcagccataaaaaaggatgagctcatgtcctttgtagggacatggatgaagctggaaaccatcattctgagcaaagtattgcaaggacagataaccaaacaccacatgttttcactcataggtgggaactcaacaatgagaacacttggacacagggcgaggaacatcacacaccagggcctgtcatggggtggggggaggggggagggatagcattaggagatatacctaatgtaaatctcgagttaatgggtgcagcacaccaacgtggcacatgtatacatatgtaacaaacctgcacgttgtgcacatgtaccctagaacttaaagtatattaaaaaaataaattaaaaaaacaaatcaatatttaaaattgcgttactacggcgatatatttcttttctatatcattttgaaattgtgataaaattgctttaatatgaacactaaaagcagtatacagaattactttcttaaagttcttactgaccagtaaattacttttttggttccgtactctcatcaaccaaatatagtgttctctatttaggtttagaaaaatcttgaggtcattagttatttccctgtattcacacagtattaccactagaccacagcatttaaatagatttttaaaagatttttagaaaaaaaaatcatagccattgctccttcactgctgaagacagaatgagatttggtttcaacaaatacttagatatgaggaagagcctttctaattggtaaagtaacatagtctccttcagaaggatacatgtattttagaaataaaatattcaaaataggagcatgctattacaggaaggttactaaatcaaagtgagctgaaaacgttgccaacatagaataataactgaatttaatgacaattttatatttgtttatttgtttattttaccttatttttcttgagacagagtttcactctgtcgtccgggctggaaggcagtggcgtgatcttggctcactgcaacctccgcctcccaggctcaaatgattctcgttccttagcctaccaagtagctgcgattacagggacgctccatgcctggataatttttgcatttttagaagagacagggtttcaccatgttgcctaggctgctctcaaactcctgagctcaagtgatccacccaccttggcttcccagagtgttgggattacaggcatcaaccaccacatccagccagaaattaaacacaatttaaaacaaatctctaggggctttttgttttccattagataaaatatacttaactttaaagattagtatcatacaactaagtaataatatacttatttatataagatatatttgtaagagaaatttaaaaattgtctaaaatattagaaattaaaaattttataaactactaacctgtcatcatgctcatatgttttatttctatttatttgtgaaatacagcattttttcagtccttgtttatatgaaaactgtctaaaggtttgatagttaatcactctatctttcctggaacactctttatatgggttatagaatatcatattccacactactggctgccttagtgatcactcttcattcttctatttagctgattcgtttacctattcacaactttcaagtgatggcgaccacaggcgcctctgccctttttcttattttttttttaaatttcaacttttattttaggttttggggtacatgtgcaagtctgttacacgatgtttcataatgctgaggtttggggtacaattgatccagtcatcgaggtagtgagcatagtactcaatatgtagtttttcagctcttgctcccctccttcccccacctcctctaatagtctccagtatctattgttcccatctttttgtccaggtgtacccaatgtttagctcccacttataagtgaaaacatgcagtatttggttttctgttcctgcattaattcacttggtataattgtttccagctgcatcaatattgctgcaaagggcgtgctttcattcttttttatgtttgcatagtattccatggtgcatatgtaccacattttctttatccaatacaccactgatggacactcagattgattccatgtcttagctattgtgaaaagtgcagtgatgaacatataagtgcatgtgactttttggtagagcaatttatttttctttggttatatacccagtaatggaattgctaggtcaaatgatgattccattttaggttaattgagaaatctccaaactgctttccacagtggctgaattaatttacattcccaccaacaatgaataagtgttttttttccccccataacctcaccagcatctgttttttgactttttaataatcaatactctgactggtgtgcggtggtattttactgtggttttgatttgtgtttctctgattattagtgatgaacattttttcttatgtttgttagttgcttgtatgttttcttttgagaagtgtctgttcacgtcctctgatttttaatagggtgtttgttttttgcttgtcgaattaggttctttatagatgctggatattagacttttgtcagatgcatagttcataaacactttctcttattctataggttgtctgtttactttgttgatagtctcttcgctggggcaaagctctttagtttaattagttcccactcatcaatttttgtttttgttgtaattgcttttggtgactgagtcaaaacttacgtgccaagagcaatgtctagaatgatatttcttagatttccttctaggatttttatagttttatgtcttaaatataagtaatttattcatatcaaaaaaatttttgtatgtggttgaaggaaaggcctagtttcattcttctgcatatggctagcgagtatactagcaccattcactgaataggcaatttttctctatagtttgtttttgtaagttttgtcacatgtcagatggttgcaggtgtgtgactttatttctgagaactctattctgttccactggtctatgtgtttgtttttgtaccagtaccgtgttgttttgattactgcagtcttgtattaataatatagtttgatgtagggtagtgtgatgcttccacctttattctttttgctttgctcatatgagttatagtaccatgcttaaccctaggtaatgtggggttcattcattcattcattcatttaacacgttcactaaatagaaattactgagttgtgagagtataaaaaatgaaaaagctcacaaggagatggagttgatctcacacccccttctcctgaatgttctttagaaataattcatccatattgaccttatcaaacaccaacctccttcctacctcaagcttttccatttgcttttgtctttgcctgtaagactcttgcatcattatcctcttttaacattctggtctcaaatgacacaaactcctctgcatatactcatccacaaactactctatcactattatttttatagcacatatgcttatgtgaaattatgttacatatttacttgtgtatggttttgcagcctgtctctgtccatcatctgtaagctccattcgagtagattttttttgtgatttgccattatttaagagggcaataataatttgttaaatgaatactacaactgatttaaactgtcccatagaagtgatatttacggtgtcttttaaataaacatagaaattaaccttctcagtcttaaaacttgagagagctacatttgttttatctgagttattttctaaggacaccaaccatcgggcctcccagagagtatcaaggaactgaaacttactagagcactgcatctgggcaacgagatacaagacccttcactgtcatgactggctaactgagtccctgtttactgttaaccaactcatcttctttatctgtccctaattcctgttttcctgcatgtagttacatttcttctctgcaatataaacccctgattttagtcagtctgggagatgtatttgacactaacctcccatctcctgggctgcagcacctgattaaagccaaccctggcaatgctttttgtctcagtgatcggctttctgtgcagtgagcaacaggacctagaccaaggatgtccgatcttttagcttccttgggccacattggaagaagaattatcttgtgccacacatataatacactaacactaatgatagctgaaagctttaaaaaaaatcacaaataaacctcataatgttttaagacagtttatgaatttgtgttgggctgcactgaaagctctccttggctgcatgtggcctatgggccatgagttcgacaagcttgatcctagaccaaacccctgacatttcagtaacacttacgtgtatgtgtatcatgagctgccaagatgtataacacatggggattatgagaaaaacagttcaagataagatttgggtggggacacagccaaaccacatcattccaccctggcccctttcaaatctcatgacctcacatttcaaaacacaatcatgccttcccaacagtccctcaaagtcttaactcatttcagcattaatccaaacgtccaagtacaaaatctcatctgagacacagcaagtaccttctgcttatgagcctgtgaaatcaaaagcattgttacttcctagatacaatgggggtataggcattggtaaatacacccattccaaataagagaaattagctaaaatgaaggggctacaggccccatgcatgtctaaaatccaggggggaagttaaatcttaaagctcccaaatgatcttctttcactccatatcatatccaggtctcactgatgctagaagtgtgctgccatggccttggacagcactacccttatggctttgcagtgtatagccccctcttggctgctttcatggctggcattgaatgcctgtagcttttccaggcacacacagcaaactgtcagtggatttaccattctggggactggaggacagtggctctcttctcacagctccactaggcagtgcaccagtggggactctgtgtgggggctcccaccacacatttctcttctgtacttccctagcagaggttctccatgagaattctgcccctgcagcacacctctgcctggacatccaggcatttccatacatcctctgaaatctaggcagaggttcctaaacttcaattactgtcttctctacacccgctggaccaacaccacatggaagctgcctaggattgagaattgcatcttctgaagcgatggcctgaactgtaccttggcccattttaaccatggctggagtggctaggatgcagggaaccaagtcctgaggctatacacagcaggggggtccctggacccagcccaggaaaccatttttccctcttaggcctctgagtgtgtgatgggaggggatgctgtgaatgtctctgacatgcccagcagacatttcccccattgtcatggtgagtaacatttggctcctcattacttacgcaaatttctgctgccaactggaattcctctccagaaaatgtttttttttttttttttctactgcatcatcaggctgcaaatttttcaagcttttatactctgcttccttttgaacactttgctacttagaaatttcttccaccaggtaccctaagtcatctctctcaagttcaatgttccacagatatctagagcaggggcaaaatgctgcgtctctatgcatagcaagtgtgacctttactccagttcccaacaagttcctcatctccatctgagaccaactcagcctggactttattgtccatatcactttcagcagtttgttcaaagccattcaacaaatctctatgaagttccaaactttcccacatcttcttgtcttcttctgagccctccaaactgttccaacctctgcctgttacccagttccacagtcacttccacattttcagatgcctttacagcagtgccactctacctggtatcaaattactgtattaatccgttctcacactgctatggggacataccagatacttggtaatttataaagtaaataagtttaattaactcatagttctgcagggctggggaggcctcaggaaacttacaatcatggcagaaacatacaagacatccttcttcacagggtgacagcaaagagaagtgcagagtgaagtaagggaaaaatcccttataaaaccatcagattttgtgagaactcactcactatcatgagaagggcatggaagtaacctccccatgattcaattgtctcccactgggtctctcccactacacgtgaagattatgggaactacggttcaagatgagatttgggtgaggacacagcaaaaccatatcaccctctaagaatttatttatctaagaatggggatacattgttggcaagttttcaatctataacctataaatatctgctaattttcgcattgacagcttctcatattcgtctctcaagatggtggacaaggatgagaaacataggtatgcttttgtactcatgggcctcacaattggacaggttggagagacaaaatgtacacataaaaacacaattatttcccaacatttctgattaaaactgtgaaaaggaaacatgtggtgctattaaacggaggtgctacaactagagaacagatcttaagatttatagtaaactagactttaaaactcactgcagacactcacaaatcacaaaatacacaaaatgtattttagttcatagagcgtatagtaattgtgttatatgtacagtctaatttagtatatcatttgagtattaaaatgataaactaggccaggtgcggcggctcacgcctgtaatcccagcacttcgggaggccgaggtgtgtggatcacctgaggtcaagagttcgtgaccagcctggccaacatggtgaaactccgtctctactacaaatacaaaaaaattagtctggcatcgtggcgggcacctgtaatccaagctacttgggaggctgaggtaggagaattgctagaactctggggcaggaggttgcagtgagctgagatcacaccactacactccagcctgggtgacagagtgagactccatctcaaaaaaaaaaaagaaaaaaacttaattttattaggattttgaacaaggggtaaaagtagacatatatcagtaggaagttacataaattaaagctgtcttttaaacaaaaagtcttcctaatttttggtaagaacgttattaaaatatgtatattttaaaaatgtgtgggattctaaaggccctgtcagcatattttcacgaaaactttcttctcgaatattacagtgccatggatgacatcagagttacttcaagagtttaggtattaatatcctaaagtttacagttgatgaggatgtaagcactgtaccaaactagatgcaaagttgtgtttttccatcactctggaagtgaggagaaagaggaggaaaaattaactaacatcaatgtgcttcacatgagctaagtgtgtcattctccatcaagcccaaacaataatccagcaaaatagttcttcttattcctatatgattacaaggtttaaagaggttaattaactgctgtacaatataatttttatgagttaaacaaaaacaacaacactagtgacatcagtcaataattttcatatactctagagtgcccaaacctaacggcactcaggaagaacatgatttatgacatctattataaaggaatcaattttttttggttcatgatttaggtatctttctaaatatgattgggggtagtatgtaacttatttaaatattatgtggtttccaaaatatgtaacaaatgatatcagctttgtgatgtccttttatctgctaaatttgaaatgtgtaaaattcaataattatgagtatggatatttactcatatctgtattaacatgaataacacatggcagacaaatcctgcattggtgatgctcacattagatttttaaaataaaaatgtgatataattctacagagtaataaggcgagaataattaatatagcagaatgaatgtaaatttacaccaagaaaatagaataataagatttcaattattttcttcattattcagcacattttctacttttgatttctattcttacagtgtgtgttaaacacaatatgtttcgacttagttatcatgagaatataattaattactacagaaggtaattgcatacctgtatgaaggatgtttcaaacttgaaaacttagggaatttcagtgaggcatcacgctacctgacttcaaactatactacaaggctacagtaaccaaaacagcatggtactggtaccaaaacagagatatagatcaatggaacagaaaagagccttcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaaggtggcaaaggatatgaacagacacttttcaaaagaagatatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggtgggagtgtaaactagttcaaccactgtggaagtcagtgtggcgattcctcagggatctagaactagaaataccatttgacccagcaatctcattactgggtatatacccaaagaattataaatcattctgctataaagacacatgcacacgtatgtttattgcggcactattcacaatagcaaagacttggaaccaacccaaatgtccaacaatgatagactggattaagaaactgtggcacatatacagcatggaatactatgcagccataaaaaatgatgagttcatgtcctttgtagggacatggatgaagctggaaaccatcattttcagcaaactatcacaaggacaaaaaaccaaacaccgcatgttctcactcataggtgggaattgaacaatgagaacacatggacacaggaaggggaacatcacactctggggactgttgtggggtggggggaggggagagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaatataaaaaaagaaaatataatggactaaaataattaggtccttagtatcaggggaaatcttgatttagtcatttttcttaaacacataattatcaagaaattacttactcaggctcacattgtttccttcataatttcttcatagttatagcaatcacattgtagcagggaataccaaacttattattatcattaaaaacaaatattaagtaatttgttttcaagaacacaaatattttaccccgacatggtttccaaaattctttttcccaaagtctttgaggcaactactctgactgattttgtaacagtgcaattcacaaaatctcccaagtatgatttaacatcaggaattactataaaggaattactataaagtggtttgggtgtgtgtgtgtttgtgtgtgtgtgtgtgtgtatacatatacacacacaaaatatatatatacgttttgcaggcatgtgacttagtcatattttagtgaatttaactggatgtcaaggtatccttaaaggacaaaagagaaagaaaaaaaaaaaaacagcaggcggaactcttcatgtaaccactgagaaagtcctgtgctttttttacttcttcctccctcttccctgtttttaacacctggaatgaccaatatgttttgacaacatgttggcaagttccttatgcagtttgacacttaatataaggtgtttgtatagttcagtttctacagataggatattgacacagctatttaagattgtaaaaaatacttgctttagggctatttaccactaaatgttttgggaaatgtgcttttcaaaggtaaacgtaactcgacccttaaaggtatgaaataacacattccttgtaaaatttatttatttaaacacagttgttaagtttatgaagttgacatttggcacaccgtcagactttcctaatacaaaaaattcatgtagccaaaggaacttagagatgaaccttatctgagctagtaattagtgaccctatattctatgccttaaattcttaacactgtcttcacaatctacaagattaagcaggatccaacttaggtttccctctccatcctcctgaaaaaaaaatggccttggtttttgaaacttactgttcttcctcatacttcagggcctgattcttttgttacgtgactttatcttggcataaccttcagacctccgctcagaatcacttctagaaccttccttgactctctagatacaatcatgctccctcttatctggtttcatagaaccctaaacatttctaagtgcttttctttttttttttttcttttttcttttctttttttttttttttttttgaggcagagtcttgctctgtcctccatgcttgagtgcagtggtgcaatctctgctcactgcaagttccgcctcctgggttcacaccattctcctgcctcagcctcccaagtagctgggactacaggcgcccaccaccatgctcggctaattttttgtatattttagtagagacggagttttaccatgttagccaggatggtctcgatctcctgaccttgtgatctgcccacctcggcctcccaaattgctgggattacaggcgtgagccaccgtgcctggccttacttgattgactttttaacttttatcctttcaagtttgaaataccaaggcttggaaccatgacagttttcccttatgcttaatctagcatctcttatataatagaatctctttaaataatattcaatgcacaaacatatagtaaatcttgaggaatttttattgtgtttggatctcaagggcacagatttgagttaaatattacctatagtttatgaaacattatcattgatggatcttcaaggcatatttgtttattcatttctttctcttcttttattctcatacctgtttttcctatctctctttgccaccaatggcaatctttttaatacatttaaggagtatcttttaactagaccatttatggtacattgtattatagtttagcaaatatcccctcccctttcttctacttcctattctgattttttgggctaggccatgtgacttgctttggtcaacagacatgaagaactgtgacacgggagcagtctttacatgtcatcatgtggttaggcaagttctcttaggattctattctcactatgtgaaaagcaggcctggttagccatgcgtccctgcagaaggagatatgtggaacagacatgagcccagacaaggtcagccaactcctagctgcctcacagacccataaataaaaatattgatctttgctattgcagaacagtgagattttggtgttgtttactaagaattgtttttgtaggaaaaactgtagaagcttctgtgtgcttaaaaaaaaaactttatataatggtattgctttctttttctattttcattgagcactcagttcttacacttcattctttttgctatgtgttaatcaaatcctgctgcaccagaagttcacagggtacttcacactaactaatgatcacagttgtataggaatctctggtatatgttagaaagttcataatatgacatacaatgttcctgacagtggcattgtcttgaatgcttttaaattatttgactctgtagtaaagatggcttgaggttggagagaggatggggtggcaggctctccattaccatggtgagtggaacagccaggtgtgaagccaaacaagctgtagcatttagccacaatggtagtgtagtcaaagggaaacttcaaaacagaatacttgggtccagtccttagattataaacacaccccgagaaaagatcaagcagggaaaaaattgtcatggtcatgtttcagaggcatagcaccttcctgactccctactaccttatgctacccacttcttctctacaacttatgctcaggttcctggacctctgacctttacaggattttccagaatgcaggggaaaagcacaaagagaaggaagcagatcacaaaatataaatatggatgacagatctcatagacttaaaccataaaaaaggtcagagtaaacataaaaaaaagatagttaatatatattatttactatgtagtaggcaccaactgttccacataaatgacatcatttcaacatcacagcaaccctataaagtatttcttttgtttttagaacacatgaaatatattctttaaacaaatttttaagtgtatcacacagtattgttaactacagtcacaattttggaaagcagatccttagaacaataccagaaaaacaaacaacaaataactcaattaagaaatgggtaaaggatttgaataactttttcaaaaaaaaacaacaacatacacactcgacatacaaatggccaacagtacataaaaatgtgctcaacatcattagtcataatggaaataaagtcaaaactacaatcagatatcgcctcatgctttgtaggatggcttttatttaaaacaaatttttttaaagttagcaagaatgtgaagaaattgctacacttgtgcattgttggtggaaatgtaaaatggcactgtcaatatgagaaacagtatggggtttcctcaaaaaaattactaatgtaactaccatatgatccagtagttccacttttgggaatttattcaaaatatttgaaatcaggatctttaagagatatctatctgtactcccatgtgtactgaagcattattcagagtatccaagatgtggaaacagactaaatgttcattgatggatgagtggataaagaaaatgtggtatatgcatacaagtgaacattactcagctttaaaaagaaggaagtactgccatttgtaacaatgtgaacgaatcttgaggacattatggtaagtgaactaagccagtcataggaccaataccgcatgattgcatttacatgagatatctaaaatagtcgtcaaactcaagaagcagaggtggttgtcaggggctaagggaaaggggaaatagggagtagctgttcaagggttataaagttttaattgtgctatttttgttctcattttccagatgccagaactgagggttacagtaaattaagtgacttgaccaaggccacagggctagtcagtgggagtttttgaagttgaaaccagacattcttgctcctgagcccacacttttgaaaccacttaaaattttattgagctgataaactatataaatttgcatatgaggggccatcatacaccagacacaattcatacaaagaaaagaatatctaaatatatactagtaaaaaactttaatataaaaatggagatttttttaagcagataaagctaaaatatctaaaaatgaagaaaaattaatttggcttcacactttataatttattaaataataaaaacatagcgaaacatcatctatatagctttaaagggaaaaacttttgacccaagactctagtagtctttcaagttttctaagtataagcaaaaaaaaagtgtcatataagaacttacaaagtgtatatcctcaataaattgaatacataaataaactaagagatgcagcaaatgcagagcttaagagtggatgggtcagaatataaaaggagtgttgcacgtcatacataggtttaaatatggaaaatataaatggctgtttaaaaatgcctaggaaatataattaaggcaccataaattatttttaaataaaatgtatgtgactaattcttcaaagaaaatataatgaaaataaacttacagagttaaaaacaaaaaggtgagtcataaataaatgtcatgtccccagatgcctcagacacatgaaaattaaaagagtaagaaggcagcatcaggagaccagaggccaatttaccatgaaggccgcccatgggttcctaatcaacagaactatggtccttcatttaaatttcattgtccttaccctgtctgcaaagtttttcaccattcatttccttctctccattgaaaacttcttttcacctgtaccacattactagcaggtttcccttccatcttgtcagtctttaatttctctggctctttccactaatcagtccttgacatatccccaaattctgagagtctatttccaggtttttctcttatctaattatgttttcattcttagagaatggatttactttcagagtttgaacctcaactcaggtaactcctgtgttcacgtttcttttttaagctcttagtctgatattttctgcccgatccatcccaggctctttaaatgcaaccacatcatccccgcgtcagatcaaagcaatcaaagcagctgcggcaactcaatacctatcatctagggtccttctcacggagttgctgatctgtgtgaaggcaaccttagcctcacactgccatctgcctctagcctcccctcagcattaggtttcatgtactccttggtttgataactgggcaacagataaggtttctgccagccccatggtacagctccttcagcctccatcctccacacctgaggccgaggggatgggggagggtgtgggtgccaatttttctcattctatagatagttgcactcagatgttttgaaatcatttaaaatttaatttgtcctaaaagtgacctcaggctgtgacacagtctctaggctatgttaggtctgtgtttgattgtagggctacggtccaaacatagccaccatgcaagaaaatgaacgaattgcaaagaggacaaagataagaccaggaattatgagtggcttaatttagagggtgttaaggccaagaatccaggtcatgagaagccaagataccctttcagagggtctgtttccatttcccctggcaagacactcagaataaagaatatcatttaagccataagggaggtctgtgggccagtcccagagaaagtctattatatttcactcaattttcttggaaatctgtcttgtttaaagtatgttgggacccaggtcctgtgaggtatattcttattccccactcccgaaatatgtgaattattgatactgttaaaagaaaagctttagacaaatttaagagtttaattgagaaaagaaaaaaaacatgatttccaaatcagcccctagaatcaaagaaaattcggagagactttggcactgtcacaaggtcaaacatctatgggaaaaaaatgtgatgtgcaaaaactaaaactgagatacagaaacagctggattggttacagctcagcatttgccttatttaaacaaagtttaaacagttggccgcctatgagtggttaaagtatacctactggaattggctaagactaagctgtcattacagggaaacatactactaaagttaggcttttagtctgtttacctgctaagtatctgagtatggacattttccaggctagattttagttttatttagtaacacattatgggatctgaaggacacttttttaaaggttgaaacaaacaaattttacgcacatttccatttataacaaaagaaaaatgcccctttagctctggtaagtatgacaatttctaaattaaaagagcattatttacatctgaattgttaattctaatattaatttcaagtattattaataatataatcatttttcactaagccttcccttttatacccgtttacactttcaaatctaattatattccactgttgttttaaagatcaagccccaactgtttcatggtgtaccttctttctaattaagtatttgagacaaatgggagtcaggctgggactatagcatgtcaattttcacaagctgacattcacagtaaaagtagttcttgattatttccctaacagctttgatgttaaggggaaaaaaagcaacaacaacactgagctgtgtatattccctcctcatgctcctgggtgagaaatcatagttagtagctgctgatcttaaaaatcagagtctctgctacattgttagcaataatctaaatcaatacagactaacaacacaagccagtatgtggtgagtcatgaaaaataaatcagtagtgatatcaattgaaaatgataccaaaaaactatattatctggaaggaaaaatacaattttataacactcttggtcctgaatagttttgactatggcacacaaagcaagcaagcagcgaattacatgactgttactttctttctactgttagcaccctccgctaatagattgtaacagaatgactgtttggagggttaagcattgggaaatgtccataattacatagcatgtttggtaacatcgtgacattttaataaaacacagatatacattatagaaaagaagatctagccatctttttacactctctagagatcaataaatgtacccttgaatgacagatgggtgttgaaacccctttgcaaataattcctcaggtagctcttctaagctctgaaacgctacaatagttctcaaaatctcaacagagggaaataaaatacttcacagttgtaatgattttctctttatatatatactttctgaaaaagtatagtgagaatactaagtatttgggaactgattttaaagtccataactattaaaaattgcaagaatttttatggagcatatttatttcataaatcagtattaaagcctgaaaaaagaagtcttaaaagtctacataattctcacaatgttatatatatgttatatatatatatgttctatatatgttttatatatgttatatatataaagaacatatttctcacaatgttatatatatatgttatatacatatatataaaagaaagttggtcaaaattgttcatattgagaggtgacaacatgctggtggccctcacttgctctcagcgcctcctcggactcggcgtccactctggccacacttgaggagccccttcagcccaccgctgcactgtgggagcccctctctgggctggctgaggctggagatggctccccctgcttgcagggaggtgtggagggagaggtgcaggtgggaactggggctgtgcatggtgcttgtgggccagcacgagttccaggtgggtgtgggcttggcgggccccacactccgagcggccgtctggcgccaccggccctgggcagtgaggggtttagcacccgggccggcagctgcagagggtgcactgagtcccccagcactgcccgcccgcccacgctgcactcgaattctcgccaggcctcagccacctccccacggggcagggcttgggacctgcagcccgccatggccgaaccccccccacccccgtgggctcccgcgcagcccgagtctccccaacagggtgctgccccctgctccatggcgcccggtcccatcaactgcccaagggctgaggagagcgggcgcgcggtgcgggactggcaggcagctctgcctgcagccccggcgtgggatccactagccaaagccagctgggctcctgagtctggtggggacttggagaacttttatgtctagctggaggattgtacatgcaccaatcagcactctgtgtctagcttggggttcgtggatgcaccaatcagcactctgtatctagttaatctggtggggacttggagaacttttatgtctagctaaaggattgtaaatgcaccagtcagtgctctgtgtctagctcaagtttgtaaatgcaccaatcagcaccctgtgtctagctcaaggtttgtaaacccaccaatcagtgctctgtgtctagctcatctagtggggacttggagaacttttgtgtctagctaaaggactgtaaatgcaccaatcagcactctgtgtatagctcaaggtttgcaaacacaccagtcggcactctgtgtctagctcaaggtttgtaaacgcaccaatcagtgctctgtgtctagttaatctagtggggacttggagaacttttatgtctagctagaggattgtaaataccccaatcagcactctgtgtctagctcagggattataaatgcaccaatcagcaccctgtcaaaacagaccaatcagctctctgtaaaatggaccaatcagctctctgtaaaatgggccaatcagcatgatgtgggtggggtcagataagggaataaaagcaggctgcccaagccagcagccgcaacccgctcgggtccccttccaccctgtggaagcgttgttcttttgctctttgcaataaatcttgctgctgcttactgtttgggtccatactgcctttatgagctgtaacacttgctgcgaaggtctgcagcttcactcctgaggccagcgagaccatgaacccactgggaggaatgagcaactctggacgggaggaaggaacaactccagacgtgctgccttaagagctgtaacactcactgcaaaggtctgcagtttcactgttgaagccagcaagaccacgaacccaccagaaggaagaaactccaaacacgtctgaacatcagaaggaacaaactctggacacaccatctttaagaactgtaacactcagtgcgacagtctgcggcttccttcttgaagtcggtgagaccaagaacccaccagtttcggagacaatattaaacatgttccaattactactctactttaaacaagaaccttataaattcctaaaatatataaaatataaggaatggtacaaataatgcttcacttgttggagatgaagtgaagatgaaacataaaccctatttatttatcccaattattccatgttcacatactcacaaaagactattctgtcacaatttaaccctgttccccaaaatctcctcataaatgcagtttcaaaaagaacaaaactatgcaaataaacattacacctgtagttttgttctgtcaaatttgggaatgaaacgtctctggtgaaaagaaataaacggttagccatttttaatttcaaaaatgatcagtcattcactattcatgtctcatgtgaactacataatgtcaacgctgtcacgaaagcacggtagaaaaaagagatcctctcagcttcaatttagtagagggaaaagttcctggaatatgtttttcctccctctggagcacttcagttttgcaaaacatgtattttataattcttattttgtattcaacaatagtgctctctctggctttcagagtttttccagtttctctgatatttcaaaaagttatggtgttgtcattttatagtttaacatgagtggttctcacttcattcaaaagaaacaggataccttgaaaacgatgtggccaacctctagaaatgaaaattattattgcttaataatagtaatacctaatatatgcaggggcagaagcctggttgagcatgtatatacatcaatcatttaattctcatagcccttacatggccaaactaagtcttggagatattaagaattttttctacagtaatacaaaattaaatttctggaagtctggcacattttgtcaatcctgaagaatacagaataaacgtttatttattcacctattcaattattcaacaaatgtttcctggcagactagtaagtagcaggcttagagttagacatgagaatacaaactgaaataagttttgattcctgtcctcaaggaccttacattctagtttggaagagagactattaaataaacctacagtgttaagatagatacttacagccccaggtagtggtataggatccctgaagagtatgaaattgaaactattttcttctaattaataaacatttataacagtaacagagtagaaaacacttggcaagcctatctgaataataattattctgtctttatggtaccaacataaaataagggtaaaaagcataacatttaaaaaaaagtaattatgtaatatagtaatttcaaaaacgttcatggaattgagcttttacttaggattcgtgtaggtgcaaccaaattgcaactatgctcacttaagggtcccagtttgcaacaatgattcaaaagctcaattctgatcatagctatatcaaaagattgttggtgtttccaggggcaaaactgagtctgataaatatatactcaataactgaaataaatagattcagtatttcaatggaatgactggcatccactttctatctaatgaaaggccaatatcaattattaaacgctaaaaattactactgggagtgcaaaactgaaaacctcttccaaagaaatatgaaatttaaatctggcaattttatttaaaagagcttcaaagtgtaaaaacagagctttctctttacataaatacttacgataagtaatttatcttctttatagaacagacaacagaccaagacaacttttcgcaccttggtggatgcgctctgaatgccaagccaggcaccacagtcattactaccaaaggggaagtaataaatttactgtctatacgaagactttcaggtctgtcccatgtaggtgaaaaatagcgcgacttttaatctctcatcattaacgccattaaactctatattaaattctgtgctgatgaaaattttttttaaatgtatgttagtattgtgtttccttacactcatttattacagagtgttatggtttctatttgcaattctgtcttttctataaaattttcagtttcttgagagcaaaaactggttgccacaatgaccagtatatagttggtgctaaaaacacatatgttgaataaaattgaatacatattcctaatttcaaagtaattgtacatgttacaatgtacttaaaaaacagaaaaattgccagtttcacattcactatctttattgatgggttcaagtctatgaaatttttgcctatcatatatcccaaagcacaataaagcagtttcaaagacattttaacacacttaagaaaaggagcttctgaattaaagcccaccactttcatattaacattaatacattttgattccatatagtcacaatagagtttataagacttgtccaaatcgaagctgaaaaatgttatgatggccattcacttttaattaaatacaagcattaaaagaaatactatttatattagcaatagaaaacagaacttctaaatcacttataagattcaggattttattttcttactcttctaaaatagttcatttaacttttatttgtatttttctaaaatttatcagccaccaacttacagtgtgagcccactcagagaaaaatttaaatcatcaggataataattaatatttataaaacaaggtatttatagaaagcttttttatatgtatactattaattatacatggtattttatcactctcactataataatattttaattaaaaccttgccttgaaagataatttgggatatctcaaaaaagtaaagttctatatgataaaagaatgttaactattttctgtaagcaatcttaagctttttaatttaccaaaataaacacattcaatataagtttcatgtgatatgttgatttggagtttgctaacaaaatagtcatatatgcatacagtggaaaatacataaatttaaaacatatccagattaagtgaagcttacaaatggagacaattcatatatatttatcattgttagataaattagtaattagtacattgtgcattctagaaaaacaaaaagcatattctttgtctaggttcaataatagtcatctgaaatatgctctgtacctgtggatgaaataagtaaaagaacataaaatgtatgaataaatagggtgaaatttacagagactacttttgctgtcttgtgattcggtcatttatgagtgttaaggatttttctcagtacagttcagaatattaatcaatgccttctacttacaggagggtctgcatcttcagcataaactgttgtgataggtgtacccttgactgcatccggagccaccatccctttgtatattcgtttactaaagacaggaggataatcattcatatcctgtaaaacacaattaggagtttagtacttcagttgaaaccaggttagggatacagttactagattgactcccagtcttcatatcacacaacttatttaccactgtcagccttccatcctctcaattccattactctcatttcagactggcacctcagaggaaactgccagagttctcatacaatattaatgtgtggatatcaactgaaggccgttccactggaataaagtctttcaccctcaaaaacatgccttttggagactgaagtgaccctggaatttttttctaacttctaatggtaagaggtaaaattttaacatttgaaaataagaacaagtttctttaaaagctacattctgtgaagcaggcgtaaaagattttttttaaatgctctttatatgtttttatagcaatgtaaattattttatatacttagcataatactgactagaacatttcagatacaaactgtgaaatatcctttgttgccattttacatgataaaaggagattttctctgcagcgcactaaaataatgacacttaagattagatatatttatacacagaaaacaatgttaatttactgaatttttttcagagcaacttatatgtatcttatttttccaatttggcgctatatatgcattgttattcatgcattgtcaagttcattaaataaatagttatcaggtatttcccactttcatcagatatttagcacttcagtgcgaggcactgaagatactgttgtgactcaagaaaaagatgtccctgtctttgtgtcacttaactgccattaggctagtaaaaatactaatctgcagaaaggctagtaactttgactaaattaatctacttatcagggccaaaataataaatcaagtcccctgaaaggaagaccatatttttctgaatcattttatcttttagagataattgtatataatcttttgtcaataaataatgcttattcatatggcagatttatttatttataatattttaataatccttaccctaccgtgttttgggtagtgtgggtcaaacatatttgaactgaaacctaaatttgttaattatctgctcttctcctccaagtcccctttttctcacttgctagtaaaaacaaaatttaaaaaattctacatattctttgatatttgcttagacacaacaattttcctgtacagtattaagctggaaacacataaattaacagatctcaaacttctctttttgcaaagaagtcagaataattatttcttactatcaaacaatgcttccttttatattcgccatagagttgagttctgagtagtcaatatgaataaacctgcatattctaataggagaacttgaactgtacacaaaactgaaaaataaaaaatatcatttcttctgttttgaaatacagtattcaccatctcttctatgaaaaatatttttacaataaattatggactttagaatctgaacaagtaaatgaaccgagaagttttagttctctataatgaggactgtgaagggtattgatcttgaggctccatgcagggagtaaatatataaaacattagcattcacacattttcgtgccctttccaagagtgccaattaacttaataagtggatgtggtaactaagggtgtggaaatcctttagcacccctaaattgtaacttctgaaggttcgaaaggaaggagcccaacactgcaatgtttccatgcatgagtttccaatgagctcattatgttcttaaaaattttattctttattttattctcaggggaaatttaaaaccttaatgtcacaaggtactttttggaaaatttgattcttcagaaacaaaaaaaatgtatatacttttccaattatgtcaacacagctgttcacagtgttgaatatgatgaactttttatttgcttgggaagtattcattggattcaccttctaacttgaatgtacagtgattcacaaactgattagacacacacctaagactgtaaatgactgaagcctatgaaaagattggttctcttccccctttattttctattgacaggatgaagaataaattaatgtagttattgtagtagtatttctttttatggcacgttgtacatactttggggttataatctttcattgtggttacaaaagcagctagttgcatatagtttttccacaatgcattatttcaagaggagaaatgtattgaaatgcaattccaacaagcataatcaatagttcactgtatttatgctcagggacatctgaacaaaaatgtatataaatcggcttctgtgcaaatgttctcttgtgcagtaaattaaggactcgctcagcactccaaaaccatgctcttttctcttgcccattattccactagagggtagtattagcaaaaagaaatatttcctcctctgtagttaagaattgtatcactaaaacccataatatttgtttcttttggtaaaaatttttattggtctcaacaaaaaatagttttaatgcttcaaaagagtattctgaatgttatgatttacaacttgaaaaaccttatggtttttttcttaaggaaaactttaaaaaatggttatactcataaagcctgcaatttgtttccatgtgtcaagcaaataaaattatacctgaaggtgtaggtagctaacaggagaaaactatgttttatttatttatttgctacattagagtctgtaataatcacagaaaccttttctcctttagcagactaccaagaagatgtaaggaatctttttaatgatcatgctaggaagataagaacttgctggtaagtttgtaaatgtaatgacaagttgaagttctacacacacaaaaaaaataaaaataaagagaaaaagatgataaaatttttgattttctggaatcacaggcaaaaacctatagaacagtttttatttagaagataagtagaaagttctaactagttggaacttgatcatctttttaaaaataacgtgtaggctgggcacggtggctcgcatctgtaattccaacactttgggaggctgaggtgggcggatcacccaaggtcaggagttcgagaccagcctggccaacatggcgaaactgtgtctctactaaaaatacaacaataagcctggcatggtggcgggcacctgtaatcccagctactcgagaggctgaggaagggagaattccttgaacccaggaggcggatgttgcagtgagccgagatcgcgccattgcactccagcctgggtgacagagtgatactcagtctcaaaaaaaaaaaaaaaaaaaaagatatgtatatagcaaatgccagtccttaccatactaaagctaattcaggctctatgaggagacacagacagtataagccaatgggcggaatgactttagttgtttctgtcttatggtctagcattagcattatccttgttgagctatatggctgctctataatgccttgaggtttatggagccgatacctacttttacgtgggtgtatggttgattgtttgcctcttaccagttctgttttccactactagacactttctatttgctgtccaagttgctgtttctcatatttctcatattattagcattctgctgggtttttttctctctcaatttctgtattgtctccttgtctttactgacttatttcccttcttttatgcttctgcataaaaagtcataaaaggctacatctgcagctaaagaaaatatttgatatttttactgccaggctaggcatattcaccacaagctgatttaagaggccatgggccataagtgaacattggtggtagcctggcagtactccccaagggtctttgatagtggcacagggtaaggctcctctgcttgtggagaaggactgtttctcataggttgagtgcctgctcagccacagtacacaagaacacaaggtagaattctaaggttttgacttccagacggtaactttgaacctgttcagggcctgggagatttttgccaccctgaagggaaagacacaggtctggctggctttgccacctgctgattatagagacccatggccttgaacaaacttaagtggtagccagggtggttacagcaggtcttggacaagacccagtgctgtgctgggtttaggtctgacccactgcagtcccagcagtggggtccacaggggtgcttgtgtcaccccaaccccagctccaggtggctccaaacagagacactctgtctgggagagagcaagggaaaagaacaggagtttctgcctggtaattaagggaattcttctggatcttatccaagaccattaaggtagtaagagtctgccaagaaccacagtgttactgggcttgtggtgcctcctaaagcagatacagctttagcaacacctacatcctttcaaatacctgaaaagctttccaaataacaaatacgaagaagtccagactgtgaagaatacaataaatacccaacgcttaaatgcccagacacagacaaacatccacaagcatcaatatcatccaggaaaacatgaagtcaccaaatgaactaaacaagccaccagaaaccaatcctggggaaacagagagagtgatctttcagacagagaattcaaaatagttgttttgagaaaactcaaaaaattcaagataacacagagaagaaatttagaattctatcagatacatttaacaaagagattgaaataattttaaaaatcaagaagaaattctggagttgaaaaatgcaactgacaccctgaagaatgcatcagttttttaatagcagaattgaccaagcagaagaaagaattagtgagcttgaagacagcccatttcaaaatacacagtcagaggaggcaagagaaaaaaaagaacaaaatcaatgaaacatgactacaagatctagaaaatggcctcaaaagggcaaatgtaagtgttattggcattaaagaggagacagacaaagagataagggtagaaagtttattaaaaggaataataatgaagaacttcccaaacccagaaaaggatatcaatatccaagtacaaaagattatagaactaccagcagatttaacccaaagaacactagctcaagttatttaataatcaaactcccaaaggtcaaggataaataaaggatcctaaaggagtaagagaaaagaaacaaataacatacaatggagctctaatacatctggcagcagacatttagcagaaaccttacaggccaagagagagtggcatgtcatacttaaagtgctgaaggacaaaaaaaattcctagaagagtatatctggttaaaatatccttcaaacaggaaggagaaataaagactttcccagacaaataaaagctgagggatttcatcaacaccagacctgtcctataagaaattctaaagaaagttcttcaataaaaaaagaaagttcgtgagtaataagaaatcatctgaagatacaaaactcactggtaatagtatgtacacaggaaacacagagtattataacactgtaactgtggtggtgtataaaatattcttatgttaagtagaaagactaaattatgaaacaaaaataactacaatcacttttcaagacatagtaaaataaggtataaatagaaacaataaaaacttaaaaagcatggagatgaagtatagagtttttattagttattttttcttgtctgtttatgcaaacagtgttgttatcagcttaaataaagggttgtatgatagtatttgcaagcttgatgataacctcaaaccaaaaaatgtacaatagatacataaaaaataaaaagtcaacaaaatcaaagcaccagagtatactaccttcacttaaaggaagacaggaaggaaagaaagaaagaagacaaaccataagacaaccagaaagcaaataacaaaatggaagcaataggtccttagttataaaaaataacattgaatgtaaagggattaagctctctaatcaaatgacatagagtggatgaacggattaaagaaaaaaaagacaaaatgatctgttgcctacaagaaacacacttcacctataaagacacacatagactgaaaataaacacatggaaaaatatattccatgctaatggaaaccaataaacagcaggaatatctgcaattacaggaaacaaaacagatttcaagacaaaaactacacagagagacaaagaaggtcactatataatgataaatgtatcaatttatcaggaagatataacaattgtaaatatatatacatatatgtatatatatacatgtatatatatacatatatgtatatatacatgtgtatacatacatatgtattcagtgtgtgtgtgtatatatatatacacatacacacacacatatatattttcaacattggagagctcaaatatataaagcgaatattattaaagctaaagagccagatacatccccaaacaaaaatagctggaaacttcaacatcccactttcagcactggacagatcttccagaaagaaaatcaacaaagaaacatcagacctaatctccactgtagaacaaatggatctaacagttactcatagagcatttcatccaacacctgcagaatacacattctcctcagcacatggatcattctcaaatacaggccataccttaggtcacaaaacaagtcttaacacattaaaaactttgaaataatatcaagtatcttctctgaccacaacagaataaaactaaaaatcaataacaacataaattttggaaattatactaacacatggaaattaaacaatacattactgaataaccaggggtcaatgaggaaattgataagaaaattgaaaacttttttgaccaaatgataatgaaaatacaaagtatcaaaaccaatagtgaggtgtggagttggcaggacttcctgggttgatttggggactttcacaaaagacccctgtgactcagggttttgagttcttaatcaataaagtgaaggattcaaagttaaccactccaagggaggattgaaaaaagagccactctcaatggacaaaaagaaagaaaggggagggggtaacacagggatataagtcctagccaccacagccagcagtggcaacccttccaggtccccttccaccatgtggaagcttccctttcgctttgttcaataaactgtgctgctgctcactctcctggtctgtggactctttttgagttgtaacactcactgtgaaggtccgcagcttcattcttcgaagttagcaagaccacgaatccatcagcaggaaaaactcttgattcaataggatatactgaaatttttactacgtgggaaatttatagctataagtgcctacatcatgaaaggaaaaaaacttcaactaaacaaaacaacctaatgatgcatctttaaaaactagaaaagcaagagcaggctgaagccaaaattagtagaagaaaataaataataaagatcagagcagaaataaatggatttgaaatgaagaaaacaataaaaagatcaatgaaacagaaagtttgtttttttaaaaagttatataaaattgacaaacctttagccagactaactaaaaaagaagagagaagacccaaataaataaagtcagatatgaaaaagaaaacattacaactaatactgcagagattcaagggatcattagtggctactatgaacaaacatatgtcaataaattggaaaatcaagaagaaacaaataaattcctagacacacacaacccatcaagattgaactatgaagaaatccaaaacattgaacaaactagtatcaagtaacaagatatagcaaataacaagtatcaagctgtaatgaaaagtcacctagcaaaggaaaagccagaacctgatggttttgctactgaattctaccaaatatttaaagaagtactaatactaatcttactcaaactattccaaaaaaaaaaaaaaaaaaaaaaaaacaggaggagggaatactttcaaactcattctataaagacaataatactgataccaaagctagacaaagagacatccaaaaaagaaactataggcaatctccttgatgaatattgatgcaaaattcctcaacaaaataataacaaagaaattcaacatcgtatttaaaagatcattaatcatgaccaaataagatttatctcagggatactaggatggttcaatatattcaaatcaatcaatgtgatatatcatcaacagaatgaaagagaaaaaccatatgatcatttcaattgattctgaaaaagcatttaataaaattcaatgctctttcatgataaaaaccctcaaaaactgggtgtagatggaacatacctcaacataataaaagtgatatatgacaaacccgtagctactcccatactgaatgaggaaaaactgaaagcctttcctgtacgatctgggacacaaccaggatgcccactatcaccactgttattcaatatagtactggaagtcttagcaagaacaatcagaaaagaaaacaaaataatgatcatctaaattggaaaggaagaagtcaaattatccttgtttgcaaatgataaaatctaacacttggaaaaacctaaagactacacacacacacacacacacacacacacaccacacaaagtattagaactgataaatttagtaaagttgcaagatacaaaatcaacacagaaaaatcagtagcatttctatatgccaacagtgaacaatccgcaaaagaaatcaataaagtaatcccatgtaaaacagctacaattaaaataaaatacctaggaattaaccaaggaagtgaaagttctctgcaatggaaactataaaacatggattcaagaaaatgaagagaacacaaaagaatgaaaagatatctcatggtcatggattgcaataatcaatattgttaaaatgtccatactactcaaagcgttctacagattcaatgcaatccctgtcaaataccaatgacattcttcaaagaaacagaaaaaaaattctaaactgtgtatggaagtacaaaagacctagatagccaaagctatattaaacaaaaggaaaaaaaaaaacacctggaggaatcacattatctgactttaaataatattacagagctatagtaaacaaaataggatggtactggcataaaaaaaaaaaacacacatatatccatggaacagaattgagaacccagaaataaatttacacaactacagcaaagtcaattttgacaaaagtgccaggaatgtaaccagggaaaggacagtctcttcaataaatgatgccaggaaaactggatatccatatgcaaaagaagaaattaggccccatctcatgccatatacaaaaatcaaatcaaaattgattaaagatatgaatctaagacctcaaactatgaaatgactgaaagaaaacatgcggaaactctccaggagataggactaggcaaagatttcttgagtaatacctcacaagcacaggcaaccaaagaaaaatgaacaaatgggatcacatcaacttaaaaagcttctgcacatcaaaggaaagaatcaacaaagtaaagagacaacccacagggtgagcgcaaatatttgccaactacccatctgacaaggaattaaacagaatatataagcagttcaaacaactttgtaagaaaatatctagtaatctgattttaaaatgggcaaaagttctaaacaaaaatttctcaaaagaagacatacaagtgataaaccggtatataaaaaggtgctcaacatcattgatcatcagagaaatgcaaatcaaacttacaatgagacaccatcttacaccaggtagaatggcttttatctaaaagtcaggcaatggcaaatgctaataaggatgtggagaaaaggaaccctcacacactgatggtgggaatgcaaattagtacaaccactatggagaacagtatggaagttcctataaaactaaaaatagagctatcatacgatccagaaatcccactactagatacatggccaaaagaaaggaaatcagtatatgaaagaaatatctgcactcccatgtttattgcagcactatttaccatggccaagatttggaagcaacctaagtgtccatcaacagaataatggagaaagaaaatgtggtacaggtacacaagggagtactatttaaccataaagaagaatgagatcctataatgtgcaacgacataatcaatgaaggttaaaagtatatgagagaggcactttctggtgtctcccagaaaccagtgggtgatatttatggagccatgggagagattctttactacgtagatatactatttttaatcctggacatgcacattttctttgttttctctggtttggatttttataggaaatatgttatatcttagtcctaaaactctagaatagtagaattaaagatattttctcctgctatcaccaagttcactgacaaatataatataaagaacacaccaataggaatctgaaaatgcggactagaagagagggaaacatttgaaagccatacttcaaagcaaccccaacagaacaattagcaagttgtaaaaaacaatattaaatctgaccatacaccaactagctggttcacagaaattatcatttattcaaattcccacctccagacaatacctcttacctccatacaataggtatgctgtagatgaaatgtccagaatttctgttttgtttgagtctgggacaacctcctggtctctcaagcatcagcttttctgatgaaatcaaaagcaggaccctatcaacactgtcatgatggagcatcagtagcacgtaactgcctctcaggtgtccacggtttcacaaatgctgccttggtactgggcactgagttttcatctagaaaagctatcctttttcttctattctatggggtagcaatatttctttctggagaagaaaactcctctgaaaggtggaaatcttagcttcattttccaagactcactgtgtttaacaacaacctcagcccttgttacaaggtgaacctgatgatacttcatttctcgtcatttcacccctccctgcctactcccacacctgcacactaagacaggcaaacacaaccaagggtcaatctagtctcccgtcttcacagaagcatgtctccctctctcctactcccatgcagccattctatccaaaattataatgagcaaaatgacttgggtcatctgtttatctcagacaagttctttatactccttataatgctgcttagtataatatatccatttacatattcagcttttcagattcatattcagttttcagtttgctgtagaacagcccttttctttctgtgtattttctatattatgttacaacgcagactctaagaccaggtttctattataacttagtttgtaaggctagttatcactctggatcttttaaaattgtttagaattttattttcactttccagagatttgcttatatcatctaatttactatcatcacagattcagttcttctaaatatttagtatatctagaaatatacaagaaaaatatttacaagtaaaatacacaagaaaatatctctaatttactatcatcacagattcagttcttctaaatatttagtatatctagaaatatacaagaaaaatatctacaagtaaaatacacaagtaaatatcttgtatatacaaggaaaaagccttgttacattgatgttctataaaatcttttcaagaaaaaatgtatgttatttgtttgatcatcacaggttttgttttggattcttaaaacttgacactaagaaagctgtgtgcagatgtcttgataaaaatttttatttatactgtggaaatattgtttttccaaataatacttgaattttcccattcttgctccaattttaaacaggtttgatggactaggcattaaacacttcatcttttattttttcctcttgtttacaaaagaaattatgtttctgctcattttgaaagaaagaacttcaagatgttttcctgtggtgactttttgggtccaagtatctcctagcgaataccatacaattatgttatcaacaaaacagcttttcagtactgcgagtaattagaccaagtatagacaatttgaaaagctggtaaagactacatttgtagagaactgagaattgtactccattcttctcttaaaaaaaggataataatattttatgggcctcagtagtatatactagaattttaaagttatatttgtgataatccccaccctgagttatcagaaaagaggaaagcaagtgtcagtctacatttgggagaatttcctacaaattttattatgcttagatgaacttggaataaaaaagtggtattacatatgtctagagttaaatgttaagttttgctttaaatgtataataaataggcaatgactttgcatgagtcaggacgccttgaccaaaggaatggtgtgatttctctaaataagataaagcaattgatacaacacgaattaaaccaacactcttctctatctgaggaataaattatcttccagctgctgatgtagaagcgttaagtaatacccccatattgaaataaagggatgttgaggcaacattaagaacttttttaaagaggtatgaggcccagatacagaatgagggttacttagggcatatcttgctttttgaggtgataattttggacataatttaactcccctaacattttccatcaaaacaagccaagcaaatatatccaaattgaatccagagctgccaagtcagaatctatgagtgtttaccataactgtctgtcatcaaccacaccctcatcagagaaaaggccacaccatttgaggatctatttttcgatctgggaagaaaaggggaaatgtcattaatagcaagtcttttttttctcttctttgtccaaaatcatcaataaatgaattatttttctatttttaatgttttaactgttcaattccaccaagtcatatgagtagacaagagtaaaccaaggcaaatttttcacctggtccagaagatattttgctatttagtctatatagatcactctcaccttagtctttttcatctgcttacatattatggcatcttcataaccaccaatattatattccctaaatatttttgtaacagatttctaaatgttataacacaatagtgtgacaaaatcatatttcaaaatacaatacaatcaaagccctcccttcaggcaatccataattttgtcttgtcccttgatcctttttccagaccactagagcactgataattattgtctcgggaaagagaggtatgaaaagaaaaatcaggttaccccagaaaagattttgacagtttgagttcctatttccaaagaaaatttagtactgaataaagttttaatttcctgaaatagacacatttcttacctcctgaaataaatatcttaggacagagagacacaagaacggaataattaagtatatagacatgtggacccccgagaaataaagaacccagatcctgataaaactctcccaacaggtttagggtgtccgaggatggaaggagcttacgatctccattccaaggtagtttagaggtggaaacagtatccatagaagaaatggcatcaatttgtgtgctagcagataatccaggtcaagtgtaaaaaaagacagcgaaagaggtgggggccaagagaactaactagagggagctggtgtgtgtcaatctcattgagaaaagaaaggctggcgagtggacactagctcatctgaaaaatccaggtggagacacactggaattcatcaggaaacagcataacacatagagaacagaggagagcaagacaagacaactgcccaccctggggtggcacagagtcaggggagtcctcccactgtggagaaacagtgagtaagtgagtccctggggacccaccttctgccatggacttttgcatccctggactcaggagatctcccccatgagctccccaccggtgcctccaggctgacacggagaaccatgtggagtcttggcagagccatactcaggcacacagggagtcccaggagacttgtatccccagacactctggcaccagtggctgtagctcctgcagcagtggaggccagacttgcatgcctccagtaaaggggccaaatccacgaggctgagcagtgaaacattgcaggcctcatctcagctgcaccttgcaggataaggcctactgtccattccagccccacctgagttcctgggtcgggagcagctctgtacttctctgggacggagctcccagagggagaggctggctgccatttttgctgctctgcaaccctccctgtttttgctcttaggcttgggagggacagggattagggactaatgccgacccccaacacagcgcagtttccttacagaaaagcgggtaggctgttttccatgtgggtccacacccttgctacttctcaccgggcagggcttcccaacctaggacctcggcaacccccgacctgggctcttgggccagtagcagctctgtactttcctgggacagagctcccagagggcaaggcaggtcaccattttttgctgctccacagtcctcattcctgttgccctcaggctcaggagggaatgtggtggttggagactgatgcaaacgcccagcacagcacggcagcattacagaaaagcagctagactgctttctatgcaggtctctgcctctgctactctttactgcccagtgcctctggacttgggcccctagcacaaccaccttgtcaatgcctaacacttcagtcagtggtgagaaaaccccagagacaatccacaacctctctgtgactgcagctacccttgggctggggaggaacaaagggcttggccactatgcaggaactccagcacaccacagccacaatatggacagaagcccagtgtctgtttcccgtgagcccccacctctcactctttaccaggcagtgcctaagctcgggagcacggaacagccaccccatctccagctgagcattctcactgctagtggctttgtgtttccttaaggaggggctcctacagtcaactaacagccactctgccactgccacagcagtagttctgcccctgctgcccttggactggagaagaaagaaagggccaaaggttttactcactcttccaggaggacacagtcatcatatagagagaagcccagactgtcctccctgtgaatcctcaacctcccgttctttacccagctcaggccagcagtgcagccaccccactccctggctggacattcccagtaggagcagttttgagtttccctcaggttgagcacccagggacaaccgaaagcccctctaccactgctgctgcagtgatattgcccttgctgccctcagactgtggagggagcaaagaccctgagtgctttagccacacctccagacagctgcatcacccacaagcttggtcctacaatgcagccaccacaccccaggctgactgtactgattagtagtggctctgtatttttctggggtggagcaccaagagacaagtgaaaggccatctgccacagccacagccaaggtcccttcccttgttgtgtctaagctggggaaagaacataaagcctgagcttgccccagagctacaatgtgtagcctgggagtgccaaacagatatacagccagcagtcaagtgcaaaaggagccgacactttcagatcactgagaaggggcacaacaatccttaggaaatagaggagactgacgaagagtctacctactggccattccagttaagtgccatctgctggatcacagcccaaactttactattaaaaatattttgctaatatattcttctgtgaaaccaaggacaagagctcagttacaaataaaggtcatgcacaaaacctcactcctctgaaaacatctaaataaaccaactgactgtactcaaattagacagttgaaagaacatcagcgaacacagatgagaaagaaccagtgcaagaactttggcaactcaaaaaacaagtgtcttctttcctccaaacaactgtactagttccctagccaggattcttaactcagctgaaatagttgaaatgaaagaaatagaattcagaatatgggtaggaatgaaaatcattgagaatcagggaggaagtcaaaatccaaaccaaggaaactaaggattacaataaaacaatacaggagctggtagatgaaatggccattataagaatgaaccaaaatgatctgatagagctgaaaaacacactacaagagttttatattgtgattgcattaacagcagaagagaccaaactaaggaaagaatcagagagcgtgaagactggctctctgaactaactaagaaggacaaaagtaataattaaaaaaagaataaaaaagaatggacaaaacccctgaaacatatgggattatgtgaagagaccagatctacccctcattggcgtcactgagggaaatggggaaaaagcaggcaacttggaaaacatatttcaggatattgtccatgaaaacttcccaacctcactagagaggccaatattaaaatttaaaaactgcagagaactgcaagatactatataagaagacaatccccaaaacacataattatcagattctctttcattctttttaaaatgaaagaaaaaaatataaaggcagctagaaagaaagagcaggaaacctacaaagagaacccatcaggctaacagtggacctttcagcagaaaccctataagccagaagagattgggggcctatgttcagcattcttaaataaaagaatttcaacccaagaatttcatgtccagtgaaactgagcttcataggcaaaaaagaaataaaatacttttcagacaagcaaattctaagggaatttattacaaccaggcctgccttataagagctcctgaaaggagtgctacatgtgaacagccactacaaaaacacacttaaatacacagatctctgacactataaagcaatgacataagtctacataatatccagctaacaatatgatgacaggctcaaattcacacacatcaatattaacactgaatgtaaatgggctaaatgacacaatttaaagctggataaagaagcaaggaccaacgttatgctgtctttaagaggcccatctcacatgcaatgacatccataggcccaaagtaaaggtttggagaaaagtccaccaagaaaacagaaaatagaaaaagctgaagttgctatccaaatttcagacaaaaagagactttaaatcaacaaacatcacaaaagacaaagatgagccttacataatggtaaaggatacaatgcaataagaagatctaaatatcccaaatatatatgcatccaacacaggagcacccagattcataaagcaagttcttacagacctacaaagagacttcgatttccacacaatagtgggacatttcaataccccatggacagtaatagacagatgatggaggtgacaaagtgaaaaagatatttaggacctgaattcaacaattgaacaaatggacataatagacatctatagaactctccacccaaaaacaacagaatatacatacttctcatcaccacatggcacatactttaaaattgaccacacaattggacatcaaaacaatctgtaacaaattgaagaagactaaaatcataccaaccacactctctgaacatggtgcaataaaaacagaaatcaatactaagaaaaacattcaaaaccatacaattacatggaaattaaccacttgttcctcaattatctctgggtaaacaataaaattaaggcagaaataaaatatttcaaactaatgaaaacaaagatccagcataccagaatctctggggcacagctaaagcagtgttaagaaagaagtttatagcactaaatgcccacattaaaaaagtcagaaggatatcaaatgaacaatctagcatcacatctacaggaactagagaaacaagagcaaaccaaactcaaagctagcagaagacaagaaataaccaaaatcagagctcaactgaaggaaattgagatgcaaagaccatataaaagataaatgaatttaggaattatcttagttatttgaaagaattaattagatagatggatgaatagctagacaaataagaaaaaaaaagagaagatccaactaaacacaatcagaaatgactgactgaatgaaaaaagacattaccactgaccccacagaaatataaaagaacactcagagactatgaacacctctgggtacacaagctaagaaacccaagaggaaatggatacattcctggaaccattcaacctcccaagtttgtgttaaaaagaaactgaatccctaaacagaccaataatgaattttgaaattgaatcagtaaataaagagcctaccaactaggaaaagcccaggaccagttagattcacagccaaattctaccacatgtataaagagctggtaccatccctactgaaactattccaaaaaattgaggaggaggcatccctccctcactctatgaggccaaaatcatcttgataccaaaacctggcagagacacaacaacaacaaaaaagaaaacttcaggccaatatctttgatgaacacagatccaaaaatcttcaacaaaatactggcaaaccagcagcacattgaaaagctaatccaccacagtcaagtaggttttatgcctgggatgcaaggttggttcaatataggcaaatcaacagaagtgattcaccacagaaacaggactaaaaacaaaaactacatgatcatctcactagatgcagaaaaggatttcaataaaattccacatactttcatgttaagaacgcttaacaaactaggcattgaaggaacatactttaaaataataaaagccatctatgacaaatgcacagccaacgtcacactgaatgggcaaaagctggaggcattctccttgaaaagagaaacgagataaggatgtcctctcttattgccactcatcatagtaatggaagtcctggctagagcaataaagcaatagaaagaaagaaaacccacccaattaggaagagaggatgtcaaactacccctgtttgcagatgatatgattctacacctagaaaaccccatagtctttgtccaaaactccttgatctaataaacaacttcagcaaagtttcaggataccaaatcaatgtacaaaaatcagtaatagcattcctatgtaccaacaacatccaagctgagggccaaatcaagaatgcaatcccatttgcaatagttacacaaaaaagtacctaggaatacaactaaccaggtggtgaaaaatctctacaatgagaatttaaaatattgctcagtgaaatcaaagatgacagaaacaaattgaaaaacattccatgcttgtggatagaaagaatcaatatcattaaaatggccatactgcccaaaacaaagtacagattcaatgctattcctattaaactaccaaaggcattattcacaagaaaaatgtattctaaaattcatatcaaaccaaaaataagcttgaatagctaagacaatccaaagcaaaaagaaaaaagctgaagatatcacatttcttgacttcaaactatactacaatgctacggtaaccaaaacggcattgtcctggtacaaaagcagacatatagaccaatggaacagaatagagatcccagaaataatgctgcatacttataagcatctgatgtacaacaaaataaataaaaacaagcaatggagaatggactccctattcagcaaatgatgctgggataactggctatacatatgtagaaaaatgaaactggaccccttccttacaccatgtacaaaaatcaactcaagacggattgaagacttcaatgtcaaacctaaaactataaaaacacaaagataacctcggaaatatcattctggacataagccctggcaaagatttcataacagagatgccaaaagcaattttaacaacagcaaaaattgacaagtgtgacttaattaaactaaagagcttctgcatagcaaaaacaaaacaaaacgaaacaaaaaaactatcaacagagtaaacaggccacctacagaatgggtgaaaatgcttacaaactacgcatctgacaaaggtcaaatatccagaatctataaggaacttacaaatcaacaagcaaaaagcaaacctcccacttaaaaagtgggcaaaagatatgaacgcacacttttcagaagaagacatacatatggtgaacaaggatatgaaaaaatgctcatcatcactaatcatgagagcaatgcaaatcaaaaccacaatgagataccatctcacaccaatcagaattgctattaaaaagtaaaaaagaaaaaaaaaaacatgctggtgaggttgaggagaaaatggaacaaagcagtttggtgatttctcaaggacctcaaagcaaaatgaccatttgacccagcaatcccatttttaggtatatacacaaagataaacaaattgttgtaccataaagacacatgcacatgtatcattagtatcatgctattcacagtaataaagacatgaaatcaatcaacctaaatgcccatcaatggtagactaaataaagaaaatgtggcacatatatgccatggaataactatgcagccataaaaaagaatgagatcatgtcctttgcagcaacatggatgcaactagaagccattatcctaactgaactaacataggaacagaaaaccaaatactgcatgttctcacttagaagctgaaggtaaacgttgagtacatagggacacaaagatgggaacaacatacattgggggctgcttgagggtggacagatggaggagagtgaggataaaaaaactacctataaggtactatgttcattacctgagtggcaaaataatctgtacagtcaaaccctgtgacacacaatttacctgtataacaaaccacacatgtatctatgaacctaaattaaaagctttaaagaaagaaaagtgttggaaattactcagaatcatttgaattactcacccgaccattccctaaaccttttgaattaaaataataatatgttttcagttacaagagacaacatatgttaagatataacatttattttattttattttttgagacggagtttcacttttgttgcccgggctggagtacagtgctgtgatctcagctcactgcaacatccgtctcccgggttcaagcgattctcctgcctcagcctcctgagtagctggggttacagttgtgtgccaccatgcccagctaattttttgtatttttaatagaggtggggtttcatcatgttggccaggctaatctcaaactcctgacctcaggtgatccacccaccttggtctcccaaagtgtagggattacaagcatgagccaccatgcccagccaagatataatatgtatttatcaaagttttatgagttacaataacaaagacatggaatcgacctagatgctcatcaacagtgaattagataaatacaagggggtacatatacaccatggaacactatgcagccataaaaaagaataaaaccatgtcctttgcagtaacatagataacagcttgaggccattatcctaaacaaattaattcaggagcataaaaccaaatactgcatgttctcacctctaaatggtaactaaatattgggtactcctggacataaaaatagccactgaaaattaatagacagaaattgggtggggtaggaagtgaagaagcgggggttgagaaactaattattgggtactatattcactatctagttgacaaggtcattcatatcccaaacctcagcatcatgcaatacacttatgtaacaaatgtgaacatgtaatgcctgaatctaaaataaaatatgaaaatgtaaaataagacactaaaaaaagaaaaggtagtggaatacttccgtgtttcactgtgactgaagaattatcttaaaaaaataaaatccataccccaaaattttatggtcaagaacattaacctactggaaaaatacagttatactaattatgtattggtgaaatcttttttcacatcattactttgttgtctaagaaaaccactagcatatggctagctatttagcaggataacaatcatactgcaacctaagaaaagtgatgatttcttcttccatcatttcaaataaaagaaaatcttatttgtagtccctataatatgagaattgtagaaaagttgcctatgaccttcttttccttaggaccctggatacatatagtcttctactaaggtccctcagagacatttgtgttgcacatgcagaatctgaatgatctcacataatagctttgctattgtagtactggccactaaacaaaataaaaataaaaataaagaaaaagggagtaatcctcaggaacttttatttttaggaataaatgtatctgcactttcccacagtcttcaggtaaccaacagaatccaaatgatatggaattgtcagtaattatcataggtaaattctgctaaacaattcaccttaaacacataatggactttaactataatcacttcaaaagaacaaatgaaaaggcattcatgggaacaaaatacaacctgaaaatataatactggcaaagattaagtgaacatagatgcctagagttatctgcatgatctccaggattagataacctaacaaagttggtaagtcatgtaactttgatcccactcagctcttacacattttagcgactatatgaagcatgaatagtatcaccatgtagtagacaatatgtggttgccaatatttcattccaatcctatggtatgatcctgcaactaaacatttattaaaaatgtccacatctttccacatttttctatctaagcccatagatttcattgttttttaacatagaaacttgatatctatagtcacttggtaaaatctgagccataattatcaattatatttttgggggtagaacatagatacaactgtgaataaaatataaatcaaaacatgtatactaaagttaaattgtttattcaactaattactcatattcatctattttattcatggtcattgatatactctataggcttctttgcaagtgcttcatttatcttatagatcttctgtctttttcctccctccactgcccttgctctgtgcaggtatctctattcctttctgaccagccctttttcatcattccaagtctattcaggaagcagaaaaaaacactttaaataagacttttttaagtttctattttcttcccttaccaaaacaaaaatttttacaatgtaccatgatagtgaatgaacttttactttatattgcctaagaaattattgtcatgtaaagtcattttttagtaatatactcatttagtaaagtaacttgaggatttttgtatatgtatctttgtaattgaagtaaatttctcaatatgggattcagatgtcttgtataagaaacatctgtgtacttttctcaaatgctgatgtttatgatggtccccatgggacaggtccttctttggggaaggagtagagaaatctgaaagtttaagatgacgctcagaggatcacggtatgtactactatttgagaactgatcaacttacagtacttcttctcatatctacttttgtctcttaaaaatcactagaaattcaaaaagttaaaaatgccatgctctttcaggcaatcatctggcacatggtattataataaatgggataacaaatccagagaggttaacaaagtccccaaggtcatagagcttaaaaagggttgagccagaatttaacctcaattccatctaacttggaagcttatttcattccagaggtttgggccctaaattaattttagggcctaagaactcttggcccttcagagtcatatataaaatttttttagttgaaggatttgtaccaaataattatgcctgatgctgtggaatttgaactaaaatctagtctagagaggttaggacttgatggaagtcacagagctgatgcagactcaaatttccatggtctttgtacacatatttactgcctctttcaaatttatcttttatagtcaaaaatatagttatttcttatgtattcataaatatttccattggaaaatctatgttatgggtctggtaccactgtgtcattaggaattgttatcaaaacatattataggtataatagaaggaacaaaacctacatgtagagagagcaaagcaggcaaccagaagtcatctctagcccttacctttacaatcactgtgacagtagcaataccaggtggcattgttccataaatatcaaaggcctctaccagaaaagtgatacttgcttcttggtctggaaatgcctcataatctaaactccttaaaagcgatagttctcctgtaaatggatgtagtgcaaaaaagtgcttcacttctgggcttcttatccggtaagacacatttgctccaaggtcgacatctttggcctgtaataagcagaagaatagttttattagtgacgttaccaaaataaagaaatgcaggaaggatggaagtcatgcgttagtgcctaggacagcatcaatttaacgaggacaaaaagacacgttttttgtttttgttttttaaaaaagcacattatttaataatttaccagggaagagaaggagggatgggggagagaaagatggaggcagggaggaaaggagggagacagtgagagggagagtcagagagagagagagagggatctttctataagattttgtcattgttgacgttattactgtatctgtttaacttgaaaaatcactaaatgaactatatcacagtaaaaaaataaatattgtcttaaatgactgtttcttattttctactgatttgataatcatgaacaaatattttaaataaaaataaatactgagtgatttccataaacataatagatggctaaagtactataagaaaactgagaaaatataagtagtaattatttgtcacagggatcctataatacatttctagagatcactctaccatacttcctttgatttaactaggatttgagtagtagttacgcacaaggtgctgtagagagcaccaaaatgaatccagacacaattactgccctacaggttatggtctcagagaagaaacaagacacaaatactaaaatagaaaggaaaaaaatgtgacatgctatctaaaagatgttctaaattgggaacgatatcctttagctgaaaggatgggttttcatgggagtcttgtagaatggctatttcactcagcagtacagactggcaaatgcacctcaggtacagaaaaccgaatggagcaagaatgaaaatggggaagatccagagtatgctataatgtgcatttttaaatgcaaacacctcctatggtgaacctcagccttggtctcctccaatcaattattgacttaacaatcagaaagatgctattaaagcatacattttattatgtggtttttcctgcttaaaatcccctggtttttaattcaattttcaatcaacgccattatccttaacatggtaagagccactacattttctagacctttagcccctcacccctcacactttcccatcttccatgattttgaccaggctttttccccccaactactttgaacaatctttcttccttttctgcttggatagctcttacttgtccctcagttcaccatttagaaataagtttctctagcaaatattctctttgccttaagattaggttaggagctccacctctattacctaggccctttgtactgaggacctacgttttaactactaattttcttgactgatagctaaaccagcctgaaaactcgaagaaagcagtaaatttgttttgttcacctttgtatccccaaagtctttgcatcccctaggacagcatgaatttaacaacaccagcaggagacttggcatactatacatactgaagacatgtttgttaaataaataacttaactaattaattaattgacagatgaatggtggaatagatgaaggaataattgttctctccctggccagtatttgccttatttagatttgttaatgtttattgctgagttcaattatggaagggatacagagtctggaaaagtatgctaaaaacattcaagttgtggactgcaggtggaaaaatggctacttttttttttttccaaaacataccttatagaccaactgagtcagtattaaatgaggtggttgcttaaaaatgcagatttatggatcagcctaatctactgaatcaaaatgttcaggactgtgtaatttatagttaaaaacttaaaaaagaggcttgatacagagatgtcattaaaaaggagagttagattactagaagatggcttttgtgtattgaatgtgaaaacaatacagaataatgggtataaacaatatttgtaaaatagaggggaaaccaatttgtaactctctatattttttctgtgtgtacacatttatgttatatatgtataacccacacaaattcatatatatatatgtattttttgacatttgtgtgaacacaaagataaatgtgaaataaatttaatgctgagtactctggaggcacaatgtgggagattattaacttttgcttcataaactattgtattgtcaactgttggaataaacagaatattacttttgtaaattaaaaaactattaaaaagtatatttttaatttcttacaaatagatctttctgcccttaatttttgggatatctttaaagtaggcttgccacataaaatacaatatgcaatattggagaaataataaaaatttattcattgtttatctgaaattaaaatccaacttggtatgttgtattgttacttgctaattttggcacacaaaccctaatagcaaatctcctaatgtaggattcatgtaataaatgctttttcccacacacctctatttgaaggatggtagtcccagctggcaaattctcttcaacaaggacagtgtatgttgaattggtgaacacaggactgttatcatcaatgtccaaaaccttgatggccaaggttagagttgaatgacgagggtgtactgctccatctgttgccacaacaacaagttcatagtagtccctgacttctctgttaagcttcactgctgtgtaaatgctcccattggatgtgatacgaaaaagattattaaagttacccaaactgtagtgcacttgaccatttattccagcatcagggtctgttgcctattaaataaaacaaaaaaacaaaaaaattcacgtaagttttgacgggctactgtaaatgaaggtaacagttaacaaattatggtatttttctaaccaaaaattatttggccctctaaggaggaaatgacaatgacaatacaatgcaaaatttaaaacatgaaaaatattatactttaatattcttcatttaaaattaacataacaaaaacggataatgtcattagcaataacaatactatgttatgacagaaaactcataaaaatactgaatctttgtcttatgattttaataggttttgaattctaaagtgagaaaaaattttgtttgtaattcatttaacataatctgccgagtgacaatttaagattatgtaggtttttgctcactgtatatattcattttatatttatatatgtttagtaataatgttacacattatgtttgtttataataaataatattttattatgttatgctgttatttatgtgataatgtttattataataaacattaatcatatttaccataaataatatttataagtataacctgacttaatcctcatgatgttgttatgagtaaatattattaatctcattttacaaatgagaacactgtggcttatggaaggttacacaagaaagaaatatctcagtgtcccagttcttaacacaatacttcatatataaaagtacttaacaaatgcttgtggaattaatgaacattagatgaaataaaacagatttgaaactaaatctgttccaaaagtcaaataggattaaaactacagtaactgtaatgtatgtgcaagggactctttttcaacattagaatatacatctctgcataagtaagaatgtttgataccataatatacctatatttactgaaaatttgaagtcatgtaaaatcactttgcatcaaataaaatgagaaaatattgagtaaatattcatcgaatgaaatgtaataagaattaatcttagctaaaactcaattgtgatactaattatgaatctcactatcagctactgtatattttgttttgaaaagttccatgtaaaagaaactgaaataaatcttagaaactgtaaaatattatataattatgccccaaactgtcaacaaggaaaggaaggaaaacaagacacttggctgccttatgagccagggacacaaaaatcactcgaggtccataaagcgtggaatgcaatatgatgtattttaacagcacatatgcagtggtatatccagttttacaggcaatggtaaagcatgcagaatggggatgctgaatatttgcatcttctttgaaacaagaatgtctaagatgtgaaaatcatgtttacaacagtgctcctatatgtcataatgccaagcatttcagcaggatttgtctctttgactcatcaaaacacaactgcccctgggagtttgacatctctgaggtttaattctgagaaaagatagaagaattgcagaaatacctgaagagaaaaaatacggtgacagagtagaatagtttctgttgatatagtttcttttacttttatactttgcctagaatttgtcttacgaattattgacaaatcagtcaagctgatcattctagtgaaaacaaccaacactgccttctccctttttcaccaaaaaaagagggtgatctctttttttggtctgaaattactcatcaagtaaatagataaaattgtaagccaagaacaaaatataaatatgttttgtttcataataataatacccttaaaaatttcagtcactttttctgtctatggaatatcttaagatcaaaaaaactaatcatttatgcaattagaaatttaaatgactcttgttcaagttgtttttattgacccatataattgaatatttattatggtagaatggctcaatttgactgatgtggctgtgtgtccgtgtgttttatacatgtccagctgcttaactatacatccactaggaaacatatctaaacatatctaaattagttttgtttttgctcccatagcaaattatcacaaatttagcagctgacacaaaacaagttcattattttaaagctctataggtcaaaaattcaagatggtctcaccagggctatgtttctttctggagactctaaggagaaacaacttctttgctcattcaagttgttgacagaattcagttgctagagtttgtagaactgagatccccacttccttgatggttgtcatgtgaggaccaatcccggttgctagaggtccccatatcccttggttcatgacacatttccaccatttttttttttttttttgagaccaagccttgctctgttgcccaggctggagtgcagtggtgcgatctcggctcactgcaacctccgccttctgggttcaagcaattctcctgcctcagcctcctgagtagctgggattacaggcacctgtcaccatgcccagctaatttttgcatttttagtagagaccgggtttcaccatgttggtcaggctggtctcaaacccctgaccttgtgatccacccgcctcggcctcccaaagtgctgggattacaggcgtgagccactgcgcctggccatttcttccatttttaaagccagcaatggtggtcaagcccctcacattttttgaatccctccctccatctttttccattttatctttctgacctactcttcaggcatcctccttcacttttaagggcatgtaagattacattatgctcccttggacaatccaggatagtatccccatctcagaatttttaaccttgatatatgtgtgtgcacatgtgtgcaagtgtgtgtatactgccatatataaatatatagcaatctatattttaggatgggatttttttttttttttgaaacaggtcttgctctgtcacccatgctggtgtgcagtggtgtgatctaggctcactgcaaccttcacctcccaggctcaagcaatcctcccacctcagcgtcctgcgcagctggcactacaagcacatgcccccaggcctggctaattttttgtatttttatcagaaacggggtttcctcttgttgcccaggtcagttttgaacttctgggcttgagccatcctccccctttggcttctcaaagtgctgagattacaggcatgagccatctcacctggccggataggagtttttagagaaaatatccaagcagatattcattaagcagactgacagtaaatgctaaatggggcatcctcaccaatagagtttcagaattttaaataatcagtttaaattggtataaattacgatatgtcaagtacacacacattttgactgaatctatgacaacttaattcactgaattcaaagctaccatgacaagaagtatatttgatgcttatggaaaaaaagactacaatatctttggctctgtttatatgctggattacatttactgatttgcgtatattgaaccagctttgcatcccagggatgaagtccacttgacagtagatgcagaaaaagcgtttgacaaaattcaacgacacttcatgctaaaaactctcaataaattaggtattgatgggacttatctcaaaataataagagctatctatgacaaacccacagccagtatcatactgaatgggcaaaaactggaagcattccccttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatagaaacaaatggaagaacattccatgctcatggataggaagaatcaatatcgtgaaaatggccatactgcccaaagtaatttacagattcaatgccatccccatcaagctaccaatgcctttcttcacagaattggaaaaaactactttaaagttcatatggaaccaaaatagagccttcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatgggatcgaattaaactcaagagcttctgcacagcaaaagaaactaccatcagagtgaacaggcaacccacacaatgggagaaaatttttgcaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaactacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactagaaatcatgctgctataaagacacatgcacacatatgtttattgtggcattattcacgatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattgtcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaaagactacaatatcccccagaaagctactctaaaaattttaaggtgactgagacacacatctaatggaaacaaagggaacagaatataaaatgcagagctatttccttatctattcctatgtccccattaaattaaggagcataaataaggtgatgtaagttaagcaacatgagctggctaagcaaggcagttttacttctttactattctagatgaacatgtagatgttaaacaagataaccaaacatagaatcccttattatcagcagtactgtcaagaactttgcattgatgtttaatatttagtcaagcagctcagtgtatgatgctataatgaaaatatatattttcctagaaatcaattaaaagttaattaaatttgttaataagaaaaataacacatctcttttccccttgtactacatcaaagcaatgaacagtaatagctgcaactttataatcatctgtccatggttaacacatttttgtaatatacaccttactatggggcctgatttgtggctactaatttgtgaatgcatattgctgggaaattggctgatagcctgtagtcaaataaagacctcactggacagaactttgaataattgccagaaacaccacttgcaaaccttattcattaacaccaaagttagagtatatgaaagacaaccaagtaattacttaagaaaaaagtcaagggaatttattgaaccaaagttttttgtataatttttgagaagcgattttatagcatgccacttgaaaagggaaaagggaaatatatttcttaaacactaaattcattccccacccctttttttctcattatcttcttagaatggtctgttacacaattctttccatccataaaagtggaagtccattactgggtttgctaccctgggggttaccagtcctgtagagaagaccttaaagcatgcctgtatgggtggaatatactaggataaaacctcaaagaacaggttgatgtttgcactccttccactgagaagtccctgggtaggttacttgtgtaatttacaatgattcatttccatttaaaatatgtcaaatatccattcagattaattatttagatagaaaattttatgacaaaaatcagccccaaggaaataacttgaggacaaaaccaaaatgttatagctattataaaggtgtgaactaccatgtagcacctaattggcccagtgtgaagctgagagagtgctttgctctaccttttgcttgtcctttacagcgatttaagaggtcgtgtacatctttctcactttgaagtgggaaccataaaagctgttgatcagggaggttgggcagtgcatccttcatgacattattagtgaaaatacatttttaaaattattatctattaacttcaaaaagatgtacaatagttgtctttttttttttttttttaaggagctgagctatttcaagggctgtgattattagtgtaaaaggagacaagcaatttaaagactcataatgcaggtaaattttttcactctccacacaaatgcctcataatcattattgaacaatggcaagtagacttactggccagaagataacttgcataacttgaattaaaatcactaaaaacataaccagaatgaatagcttttcattctagtccctagaaatctagtccctagaaaacacatatttaacacaaataatttctcaaggggtcagctattattctaagatacacaataaactacattttatcctagcattcaaggctctacctggtcttgttctaacctatctttatgcatttatatccctcagactaactctctgacacaaactctgtgttttagtcaaaggagtctatttatggtatgaatcaccaccaagaaactctcaagtgtcagtggtttgttaccactgatgtttctttctcgcctatacagcacccactgtgaattccaaatccagctttactctatcttgtctttactcagaagagaagctaaaggagcaggcttcattggaatatgaagctcatgtggtgcaagaagaaaaaaagacatgagatagccaagctgcagcttttaacgcttctgcttggaggtcaacgtatcacctatactcctgcttcatcgttgaaggcaaatcacatgacaaggccgatgtcaaggggtgcagaaattccattccctcacacagtgggacagtgataaatcagaaacacttttacaatgtactaccctggttttccttgaaatgaccatgctctccctcaccttccctgatataggttttttttttgtttgtttttattttcccccaatccaacttaaacgttcaaaacctagcttcagttctacttcatctgggaaacctcttctttccatccagccttctggtccctcttgcacatagcaaaactcactttttattgctatttaagtatgctacgcaattaaataattggcctaaaaatctgtggtgtatccatgtattatgtaataggagacactgttagagaaaagaatctgtaaattgttttgtggagtgtacaatgtatgagaagtggaaagttggagcacagatggaaatatggtagagaaggaaaaaaaaaagatagcaagcaaataaaaataaacaatattcctgtagttgggtgttatttaacgcaaatgaactgaaggtgtcaaattaaataagacagtttaagctgttccaacataacctgcaggcctcttactaagtaagcattaggaagaaactttgcactaaaaacctttacatattcagttctcatgttaatggtaaacacttgaagattatgacatcaatgcttcaggaaaagagttgttgtcatgttcacgctcatacagcaaagaaagaaagtaatgttgtttcatgttcattaaatgtatttacatagtaaggctgtcttttccctttttcaaatattccttatagtgctgaaaacgaagaggaaaacctgggaggactcatttcatatttccccaccattgcttagtatttgataattatgcagtataggttgagtgtgtatatacctctttatgtgatggtaaaaaaaattatatattaaattatatttagttttccaacctcttcttacttctatttctccaacttcttcattctcatctttttctctgtgggcgaacatattcttaccactaaatctaagtgcattttgccatactaaccatgctatttcatgtctgctttatccagtcataaaatcttccccttatttccaaaactgattattcttcagccctagtatcacctctcagaagcatctgagtaagctaaatgcctcatcttcatgctcctgaagctcattgtatgtttctttaccacatgccctattgctttttttctgtcattttttaatagcccacatgaaattaagaattcataaggacaggatggcttatttatatcatacaatgcctgctttatttttctttttgcaatgacataggttagatatgcaataatttctgccaaaatttcttctgaagctatttccatttttcaattacatatcattcccaccccaaccacccaaacacatgaagaaataaaaattgccaattagtatttataattttgtcttaaaagaaggtatgttttctgtttattagaagaaatataagaaaataagacacattttgttctttaaataaaacttaagtgatcacataactacttattaaactttgtccttttgttacattttattgctttcttgttttcaattttgtcactatattagtcagttttcacaatgctataaataacttcccagaaactgggggatttataaatgaaagaggtttaattgactcagtttcacatggctggggaggtctcaggaaacttacaatcatggtggatggtgaaggggaagcaggcaacttctttacctggtgacagaaaagagtgaagaaggaactcccaatcacttataaaaccatcagatctagtaagaactcactcactgtcataagaagagcatgggggaagcctcccccatgatccagtcaccccgctccttggacaagtggggattataggtccctccctcaacacatggggattacaaatcgagatgagatttgggttggtacacacagccaaaccatatcagtcacctagaattctttaaggaaatctatttctaggtcagttttaaagtaagtacaatatatatacctatttttgtataattaaatatattagtttaacttttaacagtctattctagcattgcttaacctttttcattatcaactcctgtcaaaagaggattttaagatttttttctttctaatagaacccttataaatttgtacttccacagatatatttatgtatatatattatccatgctttatacataagaaaagtaaggttttcttgtctcccaaaacctgattttccacattggaaatgatctaccaccgttgagaatgcatgctctagccaaaagagagtcctctgtaacttccttatataccataaacatttccacataagcattgttctttcagcactcattacagtggcatcactttctaaaatgtctgtccatattactatatggggcaactcagggtatctctgagcttgtactcaatactcatcacttcttaagtaatgaaataagggaaaaataccatctccatgaattgcattttatgtgataatctgcttagcccaggccttcctatttatttgattatgcttacattttctgccaagttataacacaaagtattgtggtttgttttctgaataactattttaaatagtcttctctatgcttattgaatatgtgacattttgcttatcaggtgtttttataggtcctatatactaatccaagttttaattttcttttttctagtattctgttgggttcaatataaacatgcccatgcccttctctgaagagtcaagagtaatgtataccttaagcattgtccttctgtcacagggcttttcattatattacattgtctcacaaatcattttcttgtatcatttctagaaaaaaaattcttaactggaaactgaaaagaatgtgacagccagattggattctctgtgaaattctatacaattaaattttctggataacattcaagtaaaggattaacagaattgtaagtaaaacaagagcaataaaaatgcctctggctaatataataactatttaatgagagaaaaatatctcttaatttcccaatactatcaatcatttcatttgctgaatataagctcacgtttttcccaaacaatacccataaaattaaaggtgtttttctctattttacacacattgtcacaatttgacctaccttgataacatcacagggatagagccagatataggttccagttttattttatcatcactcattccttgagctagtttagtaattttcagctgtttcattaccttaatttgggatgtctccaaattggttgatttaaaaatgtatgttaggtattcattttgctgacaacaattcactgaagtaactgaggatcatgttttctaatgtcttgtccaacacagtaatttaaattaggaaaacagaattaattggaagaaacaacttatgtttctctatctactccctgggactgcattcaaagagctaagatgtacacaatgtgaaactgccttttgaattagaagttatgaactcagattctgctgtgtccttccttttccagctgccttccttcagatatactttcctagtaccttcctgtgtgctactatgtaaatagtaggtaactattttagaatcattcctcagcagcaggctttatgaaaagtgctgtcagtttgttttctttaattgtggtgtaaacagtactgctgcttaccttaatattaattatatacacacatttttagaagttacagatatataaaagggccaggtactttattaacatccttttttctttctggtaaaggtaaaataagccagattggagattaaaaagtgtaggaaacttcatttggatgccattcctttgttaattgttagcatgtaggcaataagaggaatatttcaatatcaattggccaagcagaaattttcctgagaataacagaatgttttcaatgacatgttatttatggagtgtaactgttccacaggagcagtctagtcagtagaattaaatgatactgtatactagaactggaatctgagataaaatagaagtggtaagtttacaggcacactctgtttcattgcacgtggctttattgtgcttcacggacgttgcattttttacaaattgaaggcttctgacaaagatgccttaagcaaatatattggcaccatttttccaacagcgtgtgctcatttcatgtctctgaggcacattttggtaattctcagaatatgacaaacttttaaattactactggatctgttatggtgatctatgattagtgatcttttaagttactattgtggttgtgttggggtgccgcagaacacaccatatgagagcaaatttaattaataaaggttctatgtatacatttttttgacacatggtccaagatgagatggtgtatgtgttctgatttctccacccactgaccattcccccatctttctcactttccttgagccttcctattctctgagacacagtgaaattaaaattaggccaattaataaccccactatgtatgggctctaagtgtttaagtgaaagagttgtgtgtctctgatttgaaattaaaagctagaaatgattaagcttagtgagaaaggtaggtcaaaagctgagaaagcttaaaaacttggcctcttgtgccagttagccacattgtgaacgcaatggaaaagatatttcataaattaaaagttctactccagtgcaaacacaaatcataggaaagtaaaacaacctgatgtgaagctgatgtgaagaaagtttgagtggtctggatagaagatcaaactagccacaacattcccgtaagccaaagcctaatctggagcaagaccttaactctcttcctttctctggagcttgagagagggaaggaagctgcagaagaaaagtctgaagctagtagaggtgggttcatgaaatttaagggaaaaataaaaagccatctccataacataaaagtgcaaggtgaagcagcaagtgcagatgcagaaggtgttgcagctagttatccagaaaatccagctaagatatttgtagagggtggctacgctaaaaaaacagatttccaatgtagataaaacagttttctattagaatatgccatctagaacttccgtaacttaaaacagagaggtcaatgcctagattcaaggtttcaaaggatgggctgactttcttgttaggtgctaagagctggtgactttaagttgaagccaatatttattgaccattctgaaaatcctagtgcacttaagaattctgttaaatttactctgtctgtgatcaataaatggaataacaatgcctaataaaagcatatatttatggaagcataaactatgtttacagcatagtttagcaagtattttaagcccatggttgagtcctactgctcaggaaaaaaaaaagacttctttctaaacattactgctcattgagaatgcacctggtcactcaagagttctgatggagatgtaaaaggacatcagtgttgttttcttgcctgttaacacaacttccactctgcagctcatggataaaggagtaaatttgaggttttcatcttattatataagaaataaatttcataagattatagctgtcattgatagttattcctctgatggatctgcgcaaagtgaactaaaaatcttatggaaatgattcaccattctagatgccaatagcaacatttttgattcatggaaggaggtaaaaatatcaacattaatagaagcttggaagaagttgatttcttccttcatgaatgactctgagaggttcaagagaggtttaagacttcagttggatgaaggaattgcagatgtgatagacatggtgagaactagaattagaggtggagcctgaagatgtgagtgaattgctgtaatcttatgataaacttgaacagttgaggagttgctttttatggaagagcaaagaaagtggtttcttgatatgatacctactcctaatgaagatgctgtgaacattgttgaaatagcaacagataatttagaatattttatatactttgcagcaaggattaagaagattgactccaattctgaaaaaaacttatttagctacaatgctatcaaacagcatcactagctacagaaaaaaatttaatgaaagcaagaagtattcaatgcagcacaattcattgttgtcttattttaagaaactgacacagccatcccaacttcagcaaccaccctcctaatcagtgagcagccaccgacagtgagacaagaccctctatctgtataaagattaagacttgctgaaggttcagatgattgacagtatttttttaagccataaaacactttaattaaggtatggacactgtttttcagacacaatgctaattgcagtatggagtatacttaatggagtatagtatagtgtaaaaataatatttatatgcactgggaaacctaaaaccttatgtgactcgctttgttgcaacatttgctgtattactgtggtctggaagagaactctcaatatgtctgaaatatgcttgtattaaaaatgtgtattgctttgagaaacagaaactctacaacctatctaccaagaatctttgcagataataaagaaagaagttattgacttatttcaaacttaaagtctgaggagtctaaatggagactgaagttacgtctaacatgacaagtgtgaaccactttgatttggtttgcccagaggaaacattactcctgctactttcataaagactgattgcttttgacagaaatctgtctgtgcagagttggatgagtatgatactgagaagtcataaaaccattagaaaagactgggctcagaggatctcctcataaaaatgttcacatagaaggaataagacagtgaaaaagaggctgtatttgctatatatccacgttttgaattatgacacacatagggaatatttccagagcttggtttcagaaatcccaatgaactaattcttctgagatatcataaactaaatagtgggaaagcaagccaaagaaatactgtctgatttatttattttgcagactgcacttagattttttaaaaaagagcctctcactttgattcttgtatgacttgaagaaaaagctatactgtataaaggtgtttgcaggtgggttctctggcaagcagacaatgaggcagagattagttgcaagagttttgttggggtatgctttgggggtcaacatttttggagggcaaaggacaagaccagaattggattcagggagaaagtcaaactactgtgcagggtcaactacagccttggccaacccaaggaaggagctgcagaattgcaattgcatgtcacagtttttctgagctggggtaaaatgtccagcattttacactcaggcatcagtcaggatatgggctacactgaaatgggtgtgactatgggcaagggaaccttctgtagataaggtcatctctgaagtggctagcagctgtacatccctctttactccttcatccctacatcactccaaaaagccaagacattcagctctaccttcaagggagatctgcttggcacacagtcttcataacaagcctctatcttggattggtttttttcttagagtataaaatccttgcttaacagaatatagcaaattttatacacatacacacatatattaaattattacaatatcattcattgttttcaaatgaaacagccagctacattattacctcaaaggtgaaaaagtctagggtttgatttttttgatccaaactaatatttgtcattttccacccctgtgcccagagacgtaactcatattttcctgttgaatttgtttcccaagtagaaacagaagtcttaaatatgatgaactttaggttttttcttttagttcttataaacacccagtatggcagttattattgtccatattttacagccaagaatatttcagaaaaacaaaaaataagttcattttcctttagctagcaaataagagtatttggatttgaatttagagtatgaatgtgccatctgtttgtaatttttgtgcaggtaggggatgctgctataactagtgtagcattattaattattctagctgcatgatagattggagtccagagatagaaagatgagctggacataatttagaattcactctgaattattttcatgatggggattaagggccatatcacacaaatacacacttgaaggttatcattacatagcccctcagactttacatatatttcattagaaaaataaaaatctaagttacagagaattgtcagtgggttccctcaatgtctcccttactctgtggcaagctagtctgacatgatatctaacagaaggaaaaacatacttcagataagtcatggaagtcataccatgaagtcatgagaattacagtatatagtgtgcccagagctgtgaattccactaattattttgaaacattgaaatattcatttcaaaataaatctataaaccatccaacatctgtacttatctttatcattctcctgctgctaaaattgaggaaaactccacttcctcctaggttctcaagggaacatatgacacttgagcttttgggactctgttgcctctctttctggcatttctacatccctctttactccatctattgccatcagttttcaaacctgctgaagaatttatcattacaaaataaagagaaatgagaaagaaaatataattgcttcctactatgtctgttttcctacaatctcttcacatcccaagattctatgtgagggcagtgggtgggggaagaaaaggacaacatatatatccattgcactcatttattaatgagttattttgttatttagtcatgcaaatcatgcactatacaaaacatacactatgtttcctaatactgtttacttaattactcttaaaaagtcataattagttctttaaaatgtaaaactaaaatatgacaaatgatgccatctttgctattgagatggtttggctgtgttctcacccaaatctcatcttgaattgtagctcccctaattcccatgtgttgtgggtgggacctggtgggagataactgaatcatgggggcggtttcctccatactgttctcttggtagtgaataagtctcatgaggtctggtctgatggttttataagaggtttcccctttgcttggctctcattctctcttgcctgctgccatgtaagacgtgccttttactttctgccatgattgtgaggcctccccagccatgtggaactgtgagttcaataaacctattttttctttataaattaccctgtctcaggtatgtctttatcagcagcgtgaaaatgggctaatacatctatattcagttactaaatgtgttctgtgaatgaagttggatgttgaatgcagatgctaatgtactgccacatgccagttagacacaattatgtatgtatggagatatatataataaagggtacttgtttaggaatattttacaaaagcatggcctgtcagtgtgcaccatacatttcagagacatgatgaaaaaacattaccactagagtgtcacactacaaatgtgattttttgaattctctataaaaatgtcaatttcccaagcttagcatatatgtgtgtctaaatgtaatggcaagcttcataaatgatgagcatgccaatatacgaagatttggatgcaattatttactctaaaacttcatcaatattatgtggttgcaggtaacttttaaataggcccttttggatctcacatgaattgaaataggaaaaaaatctatttaaagaagtcctgaagtagacgtatatgcttaatattaaacattgtttgaaattgaagagtctggcttaacacactaaattaagaaagaagaaagaaagcaagaaagttggatgttgaatgcagatgccaatgcagtgccacataccagttagatagcatgtggcaagttctaatgggcacaaaatgtgccttgttcacattaatgctttagtgtagcactgaatttgcctctcagtaaatgttaactaaatttaaaaaatagtattattttccccaaatacatcaattcataacattacaaaataattatgctataagtttgatttgacttaaccatacatgttttcatccatcaattcattcatttattcacccacatttattgttgactttaagctgaacaacattttcagggctggggctctaactaaggacaagagtaatgtgttctttgatcttatgtcacttgaaccaaggtgaaaaagtagatattaaaaaataattgccttttaaaaattattacagtgataaacctaagtaataaagtaaatatgcattgcataataagagcatacagcaggacttttaacccggcctcctgaaaattacattctaatgggaaagacaaatgtcaaccaaaatattaagttacgaaaataaacaacttcatattttaatggacattatgaaaaagtaaagtgaactatgagagcacataaatataggtacttaaatccaatattgtgggttcaaaaaggaaatgacattcaacagcatccagaactcttaaactttagttttcacactgtcaggaagtttggaatcccaacggtgactttcacattacttgtattaaataaaagtcatgacaaaatgattacatttttcccattagtttacaatatttgtaaatacaggaaatgacaatagatacagtacctcttgatgttagtaacattcttgagattatttgatattagtaacattcttgagattatttttagtaattaagatagaaaaaaaatgttttctatataatggcataatgacttagattcagggatgactgaagaatcattctcaagttgaatgtcaaactggggaggctctgatggcacgaagcagctttctataacaatttcccatggatgaaatattgccagacatttttgtaacgtcttgggtgatggtaaattctctcttttaagttttagggaatcctattaattaggactactctctccatttcatagctaaggaaactgagtttcatatggattagatcatttgcccaagtcaatagttactaagtgatgcagctagaatttgaatgcagacaacctaaataggaatatgctatatttgcaggcagtcaaaaatgctgtaaagaaaatttaatgttggtaaagggaaagggggtatacttgtttctggaggacagggagagtgctattgaaatggggtactcagtgaagtcatccttgcaaaagatgtctttttgaatgaaagagtgaatcacacagagagttagagaaagagtgctccaggcagaggtaacaacaagtacaaaatccatttgaaggtttggtaagcgtagctgtgttcaagaacagcaagaagcccagtgtggctggagtggagtgatgcaaatgatgttggagagagcaggaggagccaagtcatgtggagatatgaaggctatgaaaaaggagtttggattctgttctaacacaatgagcatccactgaaatgtctgagtggcaaaatggtgtcatctaatttgcatttttaaaatatcactcttgctgtagtgcagaaattgactgtaagaggggtagcacaggtcaaaaagtaagatactatttacataatctaggggaaaaatgattgtggtttagaataggtgaggagtacttgcctttggaatatgtttcagacagatttactgataatgcaagaatcagaagtggtcctaggaagcagatacttaagatgagattttggaatttgctaatttgctagccaaatggcatgcttactgtacaggagttcagagtaagtcatgattcatttgaagccttcacctgagatgaactgatatggtatatgggggaatggggagcctggtttaatgccatatctgtataatttcagatttatcggtgaacattaattcataaaacttacagagttgattggttgctaaatataacaaaggtgttgaaaaagaataaatgaagctcagaaccagcaatatcaattcagaggtaaagagtaaaaaccaatgacctccattagcacgtttaaagaagctccatatccacagacaatgacagactttactcaaaatcatgctcaagatgtaattacaacctgctctctctctctctctttctctttctttcttttttttcgagacagggtctcactcccatttcccaggctggagtgcagtggcacaaccacagctcactgcagctttgactttcctagctcaggtgatcctctcacctcctgaatagctgggactacaggtatgcaccaacatgcctggctaatttttgtatttttttgtacagacagagatttgccatgttgctcaggctggtctcaaactcttaggctcaagcaatccacctgcctcagcctcccaaagtggtgggattacaggtgagccactacccctggtctcaagacataattacaaggaaagatgcaatcaactccctgacaagtcttccacaccagtattggtagggaaggagagctggtctgggcacatgtggctacaaacacttcaaaaaaacatactgattctctggaacttctagactgaaaacttcactttcttttcatttttagatgagaacagtatccctcgcctggagatcaggtaatgacttcatctgaattagataccttaccatcttgtaagcaagatgatagatgtcctctgtacctatgtccctgcattgcttttgcaccaataactaaagtcaagttgcagcatgttctaactgtccctgctatgagtagaaaaggattattcccaaaaagaacagcaggatatgccttatagtattggcagcaccaggaggacatgactgaggatagatcttgattatgttggaaggggttgaagggagaaaagtacatcttaccaagagtttagtggtatggagatactttgtcataattgtggccaggacacctggagttgattctaaggtactgctggattattccccaaaggttgtgaaaaacagtggcctataataaacaaggtgtaggtagtgaaagtgcctggacagggatttgaagttaaaggtatatagaagtgggcattttagcatggatttcttatgtatgaccagagaaaccatctattagttttgttcctcaggagagcctaggtagcactcccaattctgaagcaatatagaaaggtgcaacaagaggtgctctggtatcattgaaaagttcagtgatggctctcctcaccaggccagagtagagggtagtgaatgttgctatgaaacttgtgttccttagtgtcaatgtgagtggaagaattctggattcagaatccaggtggaaatactccaatatcagaggcagatggatgaaatgtatcatagcaatcagcaaaaaacaacgtcaaataagctgctacgaagtgcaaagatctataaggatggctatccaaccacggtgttcccaaagcaaatacagaaaggcagccaagaaggctattgctggatttatataatctaaaaacatcaaaatcaggtaaactaaagccgcatcattgtgttctttcctgtgattaatacacatttgaagtatgagttgcttttttattgctgcagtgatttggccaatattaatagctgaggacactgactattctgactttgtccagaaaattgcacataacatcaattccaaccaagaagttcatctcatggcaaagttaggtgcaatcatatgcataggaccactggatctgttggcactaatatacagtaccacccagcagtgctgacctagtagaatactggaaaagcctcttaaagatagagctaaggatgaatttgggaatgaaatttttcagggccacagaaggaatgaccattgtatggtacatttttcttgataagaagactagatggaaatgacaaatcaagggttcagggtgggaatggcctctctcatcatcatcttgactaacccatttgggaaaggcatactttcgtccttgcaaagctaggctctgctgcactagagatcctggttttctgaagaccggggtgatgttttcactgagatgacatagtaagggtcccattaaaccaatatttatggttagtcagtagaaattattggctctttatgccaacaaatcacaaagtacagaaagaaatcactacacctatgaaaatagctaaaatttgatgaaaaagatgagagagcttgctctgctaggtatcaagactgtatgtaaaatcactataattgagacagtgtgctattgctgcaagactagactaataaaccaacacaatagaatagagagcccagaaacaaaccctcatacacatgtatatgggatttatgataatatgtattgcgagtcagtgggaaatatatatatttatatagaagaaaacaaattatactcccacctcactccacacacaaaaatcatttcagatgataaacctattacgaataacaagacaataaatctttaaaaagcaggtccttcatgacctgaggaagtaggctattttttaagcaaggtcaaaagaatagtaacacttacaaaatgatggataaatttgataatcttaaaatttaaatctgtgtgtcaaaagatatcttgcaggaagtgaaatggaagctcgagaatgggagaaatgtttgaaacatatataacaaaggaggggctcatttctataataatcaaagaactcccacagataaaaaagaacattcaagaagaaaacacatttactccaacagataaataagaaactcaaataggcatttcggaaaagacgaaattcaaaatagtaagtaaatatatgaaaagattctcaatgccattagcaaaatgctaatcacgatcataatgcgatatcactgaaaccgtaacaaggtggctcaaattagaaagactgacataccaagcacacagacaggaaccatgaccaactctcatatacaactcttggcatagttactatggaaaacaatttcgcatttccaacaaaattgaatagacacatgttcataacatagagaaactcaggcacatgagcgccaggagaaatgatataaacatattcacagcagcactgaagataacatcctcaaactggagagctctcaaacactcatcaacatgagaatgtgaaaataaattgtggcatagccacaaacagcaaataaatgaatgaacaggtagaaatgtggctgaatagtaaaaagttaaatatgaatgaaagaagacagatactaatgcacacacactctaaaattctgtttacaggcttcgaaaaaagacaaaactaaactataatgtttataaatgcttacttagatggtaaatgtgcaacaaaaaaacccaggaaattaacatagtggttaactctaggtggaggaaagcaattgcgcctgagaaggagcatgaagaaagattttctggtgatgcattctatacctgatttggacttacatttatgtttactgtataataatatactaaactgtacatttatctttaaatcacttttgtgtattacattttttttcttaaagtttaaaggacaagagttggtcttaataaaaatctccggatatagctggaattctttctgtaaaaccaagttggttgccaagcttattcctcaggtaggcaataaagtccacgtaagtaattgtagtgagttataatatttgtagagaaggaaaactgaactgaactaaagtgaataggtcatgaattttcatcagtctataaaacagaagtgcaatttgtataaagtaggatctcataaataagtaatgtagcattaaaatatatagctagatagatgtagcaggggtttgtgaggcaaaattacttggtattgcttcttggatatacattaaataatttaaatggggaaatggaaaacacaatttcaaatacatgaccaaataggctgatagcatgtctgttatacttttcttccatgtagtttttacgcctgggaaatgccttcattatctttgcctgtcccatgagtgggtaaagagatgtgctattttttccagtaccaactataaatttcaattgttctttgcattcacactgctgtgtgtggtggggggtgggggtgataatcacttttttttttttatttcaacttttatttagattcatgcatggatggtacatgtgtaggtttcatagaagggcatatcatgtaatgctgatatctggggtactaataattctattgcccatgtagtgagcatagtacccaatggttgtttttttcagttttcaacccttgtgcccctcccccagtctcttctctagtagtccctagtgtttattgttcccaactttatgtccatgtgtacccagtgtttcagtcccacttacatctgagaataggtggtattcggttttctgtccctgcattaatgtacttaaaataatggtctccagctgtattcatgttgctgcaaatgacatgatttcattttttatgactgtttagtactccatgctatatatgtaccatattttctttatcaaatccaccattgttgggcatctaggttaattccataagtttgcgattgtaggtagtgctgtcatgaaaatacaagtgcatgtgtctttttggtagaatgatgtattttcctttgggtatatacccagctataagaatgttggttcaagtggtagttctgtttttagttcagccactgcagaaagcagtttggagatatccacatttacatttccaccaacagtgtatatgcattcccttttttccacacctttgcaaacatctgttatcttttgactttttaataatagtcattttgactggtgtgagatggtatctcattctggttttgatatgcatttcttgatgatttatgatgtggatcattttttcatttgtttgttggctgcttgtatgtcttgagaagtgtctgctcatatcttttgccaaatttttaatggccttatttcttttttgtttgttgaattattttaagttctttatagaatcaggatattagacatctaaaagctgcatagttagcaaatattttctcccattctgtaggttgtttactctgttgatattttattttgctttgcagaagctccttagtttaattacgtcccacttatcaatttttgtttttgtggcaattgtttccaagacttagtcataacttctttgccaaggctgatgtccagaatgatatttcctaggttttcttccaggatttttatagttttgcatcttacataagtgattagtgcatcttgacatactttttatacatactgaaagggaggagtgcagttttattcttttgcatatggatagccagttatcccaacatttattgaataggaagtccttttctgattgcttatttttgttgactttataatcaaatggtttaattctggggtctccattctgttccgttaacctatgtgtctgtctatgtgtagcctatactactgtaggcttgtagtatagtttgaagtaggataatgtgatgcctttggttttgttctttctgcttaagatcgctttggctattcaggttcttttttgtttccatgtaagtttcagaacagttttttttttttctaattcagttaaatggtactggtagtttgataggagtagcattgcatctacagattgctgtgggcagtatggtcattttaatgatattaactcttccaatccatgagcatagaatgcttttccatttgtttgtgccatctatgatttctttcagcagtgttttgtaggtctccttgtagcaatcttccacttccaaatttagatgcattcctaggtattttattttcacttgtgactattgtaaatgtaattgcacacttgatttggctctcagcttgactgttatttgtgcataaaaatgccactgattttttttaccttgatttttgtatcctaaaactttactgaagttaccagtttcagtagccttttaatggagtctttagggttttctaggtatagaataataatttcagtgaggagagatattttgacttcttctgttcctacttggatgtcttttatttctttctttgcctgatttctctaactaagatttctggtaatatgttaaataggaggggttagagtaggcatccttctcttgttccagttctcaaggtgaatgctttcagcattttcatgttcagtatgatgttggctgtggatctgccatagatggatctgattattttgaagtattttctttcaatgcctagtttcttgtgggtttttatcatgaggaaatattggattttatcaaaagctttttctgcatctattgtgatgattttttttttttttgagacggagtctcgctctgtcacccaggctggcatgcaatggcgcaaccttggctcactgcagtctctgcctcctgggttcaaacaattctcctgcctcagcctcccaagtagcttgcactacaagcacccgccaccaagcctggctaatttttgtctttttagtagagatagggtttcaccatatttaccaggctggtctcaaactcctgaccttgtgatccaccctcctcggcctcccaaagtgctgggattacaggtgtgagccatggtgcccagctttgtcattttgagatactttttagtatgctgtgaaattcagttaggtagtattttgttgaagatttttatgtctctgttcctcagtggtatgggcctgtagttttccattttaactgtgcatttaccagattttagtatcagaatgctggcctcacagagtgcgttagggtggagtccctcctactcgaagttttggaatagtttcagtaggactggtgccagctcttctctgtatgtctggtagaatttggctgtgaatccatcctttcaagggcattttttgatcggtagatttttcattactaatttaatttcaaaactcattatttttctgttcaagcttttgatttcttcttgattcaatcatgggagcttgtgtgtttccaggaatttatccatttcatctacattttctagtttgtgtgcatagatgtgttcataatagcatctgaggatcttttgtatttctgtgaggttaattgtaatgtcatcttttgtcatttctgcttgttcttaattggatttcctctctttttatttgttaatctagctataggtctataaatcttgttcatcttttcgaagaaccaacttttggtttcattgatcctttatatagattttggggcctcaatttaattcagttctttctgattctagttatttgttctcttttgctagacataaggggttttgtttgtttgtttgtttgtttttccctagatcttccaggcatgatgatagagtattaatgtgagttatttctatatttttgatgtatgtatttagcactatagactttcctcttaatgctacttttgctgcatcgctgagattctggtgttgtaacactgttttttaaatcaactgtattgatatggtttggctgtgtccccaccaaaatctcatcttgattgtagttcccataatccctacatgtcatgggagggacctggttggaggtaattgaatcatgggagcagttacttctatactgttctcgtgatagtaattgagttctcaaaagatctgatgttttacaagcattttttctctcccttcactctgcatttctctgctcctgctatcatgtgaagaaggatgtgtgtgcttccccttccaccatgatcgtaagtttcctgaggcttccccagacatgctgaactgtgagtcaattaaacctctttcctttgtaagtatccccgtctcgagtatgtctttattagcaatgtgagaacagactagtacagtacattggtaccacagaaagtagggttgctgtaaagatgcctgaaaatgtggaggcaaatttggaagtgggtaacaggcagaggctggaacagtttggggggctcagaagaagatctaaaaatgtgagaaagtttggaacttcctaaacacttggaaggctaggaagacagaaagaagtgggaaactttggaactctctagagacttgttgaacggctttgaccaaaatgctggtagtgatttgtacaatgaagtccagctgatgtggtctcagctgaagatggggaactcgttgggaaatagagtaaatgtcgctcctgctatgcaaagagactagaagcattttgcccctaccccagatacctgtggaactttaaacttgagagagattatttaaggtatcttgtggaaatttctaagtgccaaagggttcaagagaaaacagagcattaaagtctggaaaatttgcagcctgatgatgtgatagaaaataaaaactcattttctggggagaaattcaagcctgctgcagaaatttgcatagataacaaggaaccaaatgctaatcaccaagacattggggaaaatgtctccagggcatatcagagacctgcacagcatcctttcccatcataggcccagaggactaggagagaaatggttttatgggtcaggtccagggcccactatgcagcctcagtacatagttccccatgttctgcctgcttcagctccagccgtggctaaaaggggccaatgtataggtccaggtgttgcttcagagggcacaagccctaagccttggccgcttacatgtggtgttggtcctgtgggtgcacagaagtcaagaattgaggtttggaaacctctgcctagatttcagaggaaatatggaaatgcctggatgtccaggcaggagtttgctatagaagtggtgccctcatggagaacctctgctacggtagtgcagaaaggaaacatgtggtcagagcccccacacagagtccccactggggcactgcctagtgaagctgttagaagagggccaccatcctccagactccagaatggtggatccaccaacaccttgtaccatgtgcctagaaaagccgcaggcactcaatggcagcccatgaaagcagttaggaggggggctgtacccgccaaaaccaaagggttgaagcttcccacggctatgggagtgtcactcttgcatcagcatgacttgtatgtgagacatggaatcaaaggaggtcattttgaaactttaaggtttaatgactgccctcttggattttggacttgcattgggcctttagcccctttgtcttggccaatttctctcatttagaatgcatgtgtttatcctacgcctgtaccctcattgtatctaggaagtagtaacttttaattctacaggctattaggtggaagaaacttgccttgtctcagatgagacttaggacttggacttttgggttaatgctgcaatgacttaagactttgggggactgttggaagggcataattgtgttttgaaatgtgaggacatgaggtttgggaggggtcaggggcagaatgatatggtttagctgtgtccccacccaaatctcaccttgaattttagttcccataatccgcatgtgttgtgggaggaacccagtgggaggtaattgaatcatgagggcaattacctccatgctgttctcatgatactacgttttcacaagattgatggttttctaaggagcttttccccgcttcgctctgaacctctcctgcccccatgtgaagaaggacacatttgcttcctcttccaccataattgcaagattcttgaggccttccaaactatgtggaactgtgagttaattaaacctctttcctttataaattccccagtctaaggtgtgtctttattagcagtgtgagaacagactagtacatgtaagtatactcttacacatactgaaattctaaaagtggacatatatccaatatcaaagctttttatttatttgtcaagagaacttatttatgtgtttgtatgcttgtgaggtaagacaaatatgtatgtttagatgctgacatatactttaccggttctctttttacatttaggaatcttcattacaaaactttacttttagataattttatgtcattaaatttagtttcatttcatgtatgtacatacattatgcaagggctaagccaagcgttgggctatgtagtgaaatttctaacatcaatctctactttcaagatgtttagataaatagacaacataaatatactctagcaattactatcaaaatttgtacacagtattacatgagaccatgaatagaaaacaccgagggtataggaaagttcacaaaagattttctggaaaagattatagtggctaaattttcaagtatctgagttatctttaaaaaatggagaaaaagaaaatcaaggtgggggtataaacagatgcaaagagacatatattagcaattgtgagcaagtgagtatggctagagataaagttgtcaaagtaatagtgtgaggtgggtactgtgttttgtttgttctgtgggtaataataaccatattgtgtacttaagttatttgttagttagagacataattccagaatttacatcacagataattataaagtgtcaagaccagtatcaggataactaactcacaggctgtagcaatagttcaagtgagaaataataagagcctgattatggttgttatgagagagagaatgtgagaaaaatttgtaacatgtaaaatgatcaatattggtgattacttggatatggagagtgagagagaaagaggagacttagatggctccttagcatttggcttggggaatagttaattgaggtacagaattcagaaggagccctttctggggaagacgaaaataagacttcaatcttaaaaatgttgaaatttagatgctttctggaaattcaagtggatattttacagatatatgtctatttgaggctgtagcttaaaggagtagaaggaaaataagcatctcaatgtaagtaaagctgtcggctttaatgtaattgcaattgataaaaaaggaatacatagagtcaaaagggcaacttagatgatactttcaaaatccaaagtttaaggagcaaacagataaggggaagacagaattagatgtgcttaaacatgaaaactagcagcaagcaggtagtagaatcttaagaaaaaagagagacagagagagatcctatagcaatagagcagtaaagtgacttagataaagataacatttaaaagcacagtggtcatttgtgaccataaagtggacacagatatcattcattgtatagctgggatttcacaactataaatatttacacatacacacacacacaataatgtgtatttttctaatagctgatattaagcctaaacattgctaaaggggtaggccctaaataaatattgtaaaaatatattcttaaaattttctaatctatttatgagctgctaattgaatatctgaaacatgaccacatttcaaaaatagtcacagacattaggtagatttctattgtaaatattattatgtagcacatttatattgacataaccaatttttcaaattgtgtgggcttttttctttatcagaatgagttacagggtttgcattatatagtttggcttaaaaagagaactcataaaattccccacttgcagcccacttaaaaaagaattattacagttttaggcactgttgagtgtcatactgagctacaaaaaataagaaatcaccataatgctctccaccttcattttagttttagaaccccacacagggagacaactatagtaatcagagttaggccactgaggttcagatttattttgtttaatattaaattgtatagttgaaggaaacatcatttttttaatgactgtatcactacccttccaaacactgtagtttactaatgattttaaaacttctttaagtgcttaagacagaaacattcctacaatatcttagctaagatttagcatgcaggtctcatactgggaatacatttgtgttttaagttaaataaattcagcctcttatttagaactggaagaacatgttgtagacttatggttctatttttgttacctagacctcaaagaagtcagttcagtagaaaaatttatacaaggtattacatggaagtttactgggaatcagcttactctatattatacaatgctgagaacattgtttaatctttgtttaaacattgtttaacaggcagtatagtttccaagtgtgccttctctaatgcatttgtgcaagcatttatgcccagggttgctatgaaaaacagagataaataatttagtccttaaacttgagaattctgaccttagcagactcctcaatgagatactcctacaaaggccagacacctctgatattagctgaaagccttcctacctccacttccctcccccctcaacctccatccacccatgtctcacatacagaaatgcactaaagcatatagtgtgataagtgtgctgaagtaaaaggccacctctttttcttttatgctgaattatgttaataagtacaaagaagtttttctcatgatcatgtatcttagacagaatttactgaaatagatctttatcttctcactttctaacccagactgatgattgaattcacagaacattagttgagaaaacaaatgaaaatgacagaaaccatgttgaactatgcatcatgttctcctacttctgatgacatcaggtttataatgagaccagattcatctgtctgactgttacacattagcataaattattcccaggaaatccttcaattctcttttaggaataaataagattctgagaggcacatccaagtccattgttgggattatgccatttttaattgatatataatatatgtacatatttatggggtacatgtgatattttgctggaatgtgtaaaaatcaaatcagggaatttggggtgtccatcacttagagtatttaccatttctgtgtgtggacattccaagttctctcttcaagccacttgaaaatatacaacacattgctgctaaccacagttgctgtattagtctgtcctaatgttgctaaaaaaggcatacctgagactggataatttataaaagaaagaggtttaattgactcacagttccacatggctggggaagcctcgcaatcatggcagaaggtgaatgaggagcaaagtcacaccttacatgatggcaggcaggagagagcttgtgcaggggatctcccatttataaaaccatcagatcttgagagacttattcactaccatgagaacagtgtggggaaaactgcccccatgattcaattatcttcacctggcccctcccttgacacatggggattataattcaaggtgagattttcgatgaggacacagccaaaccatatcatcccatccccagcccctcccaaatcccatgtcctcacatttcaaaaccaatcatgccttccaaaagccacccaaaatcttaactcatttcagcattaactcaacagttgaagtccgaagtcttatctcagacacagctagttccttccgtctatgagcctgtaaaatcaaaagtgagttagttacttcctagatacactggggatacaggcattgggtaaatatacccattccaaatgagagaaattggccaaaacaaaagggctacaggccccacgcaagtccaaaatccaatggggaagtcaaatcatgaagctccaaaatgatctcctttgactccatgtgtcacatccaggtcatgctgatgctaaagatgggcttccacagctttgggcagctccacccctgtgactttgaagggtaaagctcccactcctggttgttttcatgggctcatgggctggtgttgagtgtctgcgacttgccaggcccaaagtgcaagctgtcagtggattactattcttggggctggaggacagtgaccctcttttcacagctccactaggcagtgtcccagtggggactctgtgtgggggctcccacccacatttcccttctgcactaccctggcagaggttctccatgagggctctgcccctgcagcataactctgcctggacatccaggcatttccatacatcctctgaaatctaggcagaggttcccaaaccttaattattgacttctgtgcacctgcacgatcaacaccatgtggaagccgccaagacttggggcttgtaacctctgaagccctggcctgagctataccttggccccttttagccatggctagagtggctgggatacagggcactaagtcatgaggatacacacagcagaggggtcctggacccagcccaggaaaccattttttcctcctaggcctctgggcctgtgattggagggcctgccatgaatgtctctgagataccctggagacatttcccccattgtcttggtgattagcatttggctcctccttacttatgcaaatttccactgctagtttgaatttctcctcagaaaatgaggttttctttactactgcctcatcaggctgcaaatttctccaacttttatgctctgtttcctcttgagcactttgccacttagaagtttcttctgctagatatcctgaatcatctctttcaagttcaaagttacacagattcctagggcaggggcaaaatgccaccagtctcttgcatagcaagagtgaccttaactccagttcccaacaagtttctcatctccatctaagatcacctcagcctagactttattgtccatatcactatcagcattttggtcaaagtcatttaataattctctatgaagttccaaacattccctcatcttcctgccttttgagccctccaagtctctaggaagtaccaaactttcccacattttcctattttcttctgagccctccaaactgttccaacccaggcctgttacccagttccaaagttgcttccatatttttgggtctctttccagcagcaccacactctactggtacccattcactgtattagactgttttcatgctgctaataaacacatacctgagactgggtaatttatcaaggaaagaagtctaattgactcacagtttcacatggctcaggaggcctgctttcatggcagaaggcaaatgaggagcaaagtcctggcttacatggtggtaggaaagacagcgtatgcaggggaactcccatttataaaaccatcacatcttgtgagacttactcactatcccaagaacagcatgagaaagacctgccctgatgattcagtcacctcccacctggtcctttccacgacgtgtgggaattatgggagctacagttcgagatttgggtggggatacaaccaaaccatatcggtcatatccccaaaccatatggttggggatacaaccaaaccatatctgctatctaacattagaacatatttctttctttctttctttctttttttttttttagaccaagttttgctcttgttgcccaggctggagtgcagtggtgcaatctcaactcactgcaacctctgcctcctgggttcaagctattctcctgcctcagccttcctgggtagctgggattacagagatgtgccaccatgcccagctaattttatattttcagtagagacaggatttctccatgttggtcaggctagtctcaaactcccgacctcagatgatccacccgcctcggcctcccaaaatgctgggattacaggcatgagccaccacacctggccagaacttatttcttctaacagtatgtttgtaacaactttcttcatcagccccatcctccaccaccaccactcttctcagcctctggtatctatcagtctactctctatttccatgagaacaactttttcagctccagcctatgagtgaggacatgtgatatttgtctttctattcttgatttattttacttaacataataacctccatttccattcatattgctacaaatgaaaatgattttcattatgccacttttaaacatgaacatttgacaagaaattgacttatttattattgttatgtaaagtaactagtttaggctaaattgggtctactgttgggagtatgcacaataacagtaatacaataataattatgcataaccccaacaacagacccagctttaccctatttatcttatataacaataagtaaatacataatacataaaagaattttatatttttcctctaacacataatatttctttatctcccttttcctttttctctctttcttacatatacacatgcgcttgtgcatggcacaggttagtataaaccagaatcaatggcagagctcactaaaacacagatttctggccccaacactagggtttctgattcaatctctgtggtatagagtatagcagtctgcatttctaaggtgtttctattggtgctgatgctgatgctgatgctgcttttccaggaacaacactttgatagccacctaacgcatgtttgtattttttcagttcagatacgcatgagcaagtcacaggaagcatggtcattggagaatcctgtatagtagagtggttaagaccaaacatttgaaagtaattcaaatatgtacaatggaaagcatttagaatagttcgtggcacattgtaagaattcaaaaattgatagtcattattactgattttttactagagctgtcagtctatccaatatgcttctttcaatgcaagctccacatatcccactagctggacttattttaagatgaataaacaaaaatacaaaaatcaggatcgcaaccatgagctctattttgataataacaaatatctttcatttcctttaaatttctaaaatatcctacaaatgtgactatatgcatatatatgttcatgtactaaatgttgatttgtacatttgttattatcaaagaccaagctttggctaacacacttaaaaaggataaacgctgtttataatctgactgactatgattgtttgtagtgatgcagtagaagaaaatcatttatcaacttaagattttatagtttcttaagaacagtacttccattaaaatgttctctaaatatggtaatattaggcaaatgcaagagtgcaactaccgtatttcgaaaaatcataaacaattgtttgcatttagttcatagtgttgtaaaaaatattactttctataatatacgtagccatactttataaattatttagtatttaacataattataataaaaattaagtgcatattagcttcattccttattttaaacctgtacatatattatgtgtatgtattaatccttcaaatcactacttgagatgaattctattattatctccattttgcgatagcgaaatccagtcccagagaagctaaattagttatccaagattgcattagttattttggcaagtcaaatttgaactcaggtagttttattccatggcccatattttaagctgttcattaagttctccatcttgttgggatgctgggtctggattcatggagtcacgtgatctagtgacaggatgaaccaagtgaccagggagtggtcgtctcattaaagtatgtaaggagcataagaggtgagggttgttaggtaagatgagaagtccgggatccctgtgtggtgagtctagaagtcacagtccagtataaaacaggcttttaaaggtaagtggctggaaagctggacactgatttagtagactggcttagagtcagtctatctaaaggctgaatggaccttcacagaagttatatcatgctctgctgttgtatattcccaaatgcctattcctttgagacttgaggggtccaggaccaggcctgcagatttgatcagaatatgactgcatttgggggcttctactggcatctgctcccccaaagacttgggatcatctgagagttctgcagttgagtatgaggcctctagtaagaggcctctcatatctgagacccattctaaagatcaattatttgcatgcttgtggtccacagtcaagatatgcatacaaatcctctagattctatctcctgtgaaatactctcaaggatactaggcaaaatattacactaagtcttcatatcattcactatttcattaggccccatctgaactcaatgtatttttaatcatttttccagaactcctttaaacagctcttccattattgtcagaatactgacttagagtcctcaaattgcttcttcagctggattatatttcatattacatttttttggctggtatttttatttccttttttttttaaatttccaacaaagatttcactaatacattgaaaagaaccaagaataatctgcttttctcatgaaccctaacctggccacctcagtctattataatgtctctttttccttgcagtaaagaatttatagcacccatttgacacttgacacagagtatatacttactgtatttactaggttttgagtatatcttttcatacatattgttacagttttcaattctaaatgcacaaggtataatatgataccttgtgaataaaaagataaacattaaaaattgttgattggtaggttattttttaatatgctggataaaactttttgctatgtataatccataaatttgcttcaaaagtattccttagttattatttgttactacaacactacctttaaaaactaaatgaggccgggtgtggtggctcaggcctgtaatcccagcactttgggaggccaaggcgggcagatcacctgaggtcagaagttcaagatcagcctggccaacatggcacaaacctgtctctactaaaagtacaaaaatttgctgggcatggtggaggttgcctgtaatcccagcgactcaggaggctgaagcaggtgaagtttgaacctgggcggcagaggttgcagtgagccgaggtcactccattgcactccatccagcctgggtgacaagagtgagattctgtctcaaaaaaaaaaaaaaaaaaaaaaaaacaaaaaacaactaaatgaaaactcccttcagcattttaattcaaatattggattattcatattaaaatatcaatagaatataaacacaaagttgataactcaaattcagtatagtaattaacaatatgtatcttggttttaagtcttaatagtttttgatgacaattaaaattaaattttacaagcagagcatgagtaatttagtgaaattaatatatgatataattatcattaggtagcaaccattatgagcatcaaaattccatcctataaacattacactgtgcagaatcagttagatgcagcctgccttggatgtcttcctcttcctttttgctttcaacatcgttttagtttttatgaaaacaagttattgcctaaagaccaggctaaggtccatatttcaattttaaaaactgaaataaattatagaggccatttcttatcaaatttaagaaccaggagacaacaacaaggttaacacaataattcaagaacaaagaatcactaggaaaagcgggaaaaaaaaaataagaaaaaaaggaaaagaaatttaactaaaaactaatcatcatgttgatgtctacttgtgtgtttttagttatatattccatctgggctttatctctccaagctaaataaattaagaaaatgggaaagatcatttttgtaaataatttcaatgcttgtttgtttttaactgaatagttaatatatatatggctaagtgaagtttttcagttttcagcaatgtggcattttaaactgacaactgtaatataacttaattatcattaataaagacgattacattagttcaagcctcatatgcctggtttattacaattgcctcctacttctgccttctggatttagaatctcccatttcaatatatcaggagtaatttttataaaatacaaatcagatgttgccatacctcagaccctttagtggctcccccgtcaccttctacaacatggtatagaaaagtgtttatgacatggtacgtcttattcattgtaactatgctatgtcacactctgatttctctgtgcctttacttatacaactaactttccctaacagattccaacttctctcaacttctctcttacctgtgttcttccttcttgagtcaacttcagcatttctcctttgatgataatttttgcacatgcccctgttatagactttattaccttgttttcttggtgtagccaaacttgtcagtgtcctatgcatgtccctcagagcatttggtatgctttggccaacttccacctcctggtattgtcactggatcctaagggtgttgcttttccagccagaaacctctgcgggtggtggcgcctttgcccaagttttgctcggactagctgtgtttgtatcacccactccacctggcaggctgtgcttggctcatgctactgggctaaatccgacactttgccagggcaagccaggttcagagcagcgatgggtgcatgagcgagcaagtgcagggtcttgtcactgtgcatagccacgcacgctagctgctttggcgggacgggtagctccagccgccctctcccagcaaaccttagattgaatcagatacagggcaagagccttctgctgtgagcacccgcgtctggatgaggggctccctgaagagccgcaactcttctctcctttttgttgctcgccacatggtgaggggggtggcagctaaacaaggttttagccctgtttgtgttaccgctctttcattcctgccatttggtgggtcccgagtttttggcccacatccaggaagaatgaggtacgcgcacagctggagagttaaggtggagaggaactttacaaagctacagaacagctctcaagagaccgaagtgtgtagctcctatccataggcaggttatccccataagtgtccagctctcagcagagagaagacccggaataggtagttcctttctgcagaaggtggtcccaggagacacgaagaggaaatctcctccctgcagctggtattcttgatgtctgtgtgaggctggctggctccagggtttttttgggctcagaaaggaggaagtacatgttgattggtccacgggtggccatgggcaggcccggtaaaagcaccgtaagttttcactctgggccacggactccactggaactgatgggctggtccccaggcttcaggccatccctggcttgaaggtggggcttcaccagggacaccccactttccacccaggagcctgtcttctgctgccatcaatcatgttgttcatggtgcccaggctgtttatgaggagaagtgcctgcaggcccacagtgagcagccctctgtcccctcttggcctccctcctatgttcattggcgcccaaagttcacaggaggctgaggtggcagggggctggcatgtcagcaccaacccaagcacgcacacacccagcctggttgtgacagcacctgggctcggcctgaactttgcttcaaaattggaaggggtgccaggagctggaagaggtcaggcagggggaacaggcacttccgactctgtgggggcaggggagcttcctggatccctgagagcacagagatgcctaggtctgcagccacagctgggcagctggagctacacccaggatggcagggctcccaccctgccaacttggaagggggttaggttcctgcctgctccttgctcccaccggctccctggagcatttagcccaggtcatacctcctctgctgtagctggtgtctttgcagtggctgctccagatgggccactgctgccatcagtatctacagcctgactcagtgcccttctatcagattatgctgagggaatttgactacttgcttctactggaggcaagaaaatccaaaaacttggcagcccattggccaacattgcagctaattactctcaggatttagtgtatatgttttccagttccataacctctcaggaactggacaattaaaactatcaggacagataactctgatgcatgagtttgcatctttttctagagtttgcccttggagtgaagtttcagttctccttatgattgctggtttaatagcaatcttgttactggctaccttctcttctttgcctcactttctcacttccttatcactgttatctacacttctcaaaaaatatttatacatgaatattttgtgtccagattttctgttggagaatccacagtaagccattggacaccagaggtactacagtgtggggagcagagccttcagatgggatgctggagttgaatcgcttgttggccagttggtatcaagaccagttggcattttataacatcacaatgaccaagattatcccctatgtgaattgggatggcataaacatataaggttatgtatgccttatgcagtatttccagaatttgagatagtgacaatgataatgataatgactgtggagttggtagttgcaagtattgtcagtgatctaaaggaaaaaatgacttttaaaaaagcttcaactggtcaatcaaaatctcaggacatggtgtgaacatcacaagatctctataacaccatttaaagcaaccctctccttttgcagtttaaaggagattgagctaaaaatcagatcttgtgcctggttataagaatagcagaacagtagagaagcctcacttgaaagcaccagcacgccttctgtggaaaagtcagaaccttcacagggaaggagtaggaccctgaactctgggtttggaacatctgggtggctcacacctcactaaaccaagattctttcctcccctgaagaccacataaacacctcatctgaggttgatacttcaaattgtgcacatcttcctccaatttttttcttctttgtgacttctagaccaattattatgttcaagaccaagaatggcccaaatgaggaagtactgtctctgttttaacaataaaggaattattcatcaaatgaaccacagacaccggctaatatgtccaggtagatccagaagcacttagaagaacactaagagtaagtttactacgagtaaatcttctgagtgctggaaaaggtgtgtgtgcaaaatattagaaacacacggtagactctaaagatagtatttacctaatgtaatgaattcaaatctaaatatatatattttgaggtctaaatgtccacatccatacctagtagtatacctaattacatgtttctgtaaaatgttttaatttcagaaactaaaaatatatattaaattagcatactatcacattaatcaatgtttaaattatacaataattataaaatgtaaatctgtatccttgaaagttaattaaaatatataggatatgattcattttttaaagtcttgaagaatatccagcacagtcatttaacagattacattagctgagtttcttttgagaattaaaatgtaataaacttacactctttgaaaaactacatataagatctatataaatattccacttacttttacttgacccacaaaggcattggcttcttcttccaccacagataaatttcttggcagataaggatcaaacactggagcattgtcattgacatctgtcaccactatgtttactgtggcagttgaggtcttaaagaaaaacacaagcattaaatgtgagaggagctatttttacttagaattcatttaagtagtcattctggcatttgtctatctgaaaagcatctcatttttctttctaatccttagctttccaaaaaataaaaataaaaaaataaaaaaattaaaaaaaagaagcttgcaaagaagcttcccacctcaaaaaacagatgggaaaagcaaatgatgatattaaagggcaaacatctttttggaaatgtcaagtatttcctggaggaaaacggttttacctttatcttgttcacattttatgggtggcaagcttttgtttatacacacgtacactgctttatctctgaaatgtgccatttctgtagtttttgctgcttgtatgtttgactgtttaaaaataaaaccagtacattataaaatagcatggtacatcaaatgagcattttctggaaagctcatgctatcgaaaaatgctaccttaataattttctaggtgtacatttaaaccaagagtttgagtaccatatactaggcatgaaatgattatcttataagcatacagcttacggaaatggtatgcaggtaaacctaccagtagtgtgtgctacctagttaaaagttaaatccctggcctgctgcagtcaatattatgtaggtcaatgacttctgcacaatcaatgactatcttcataagtgattcaagctggaaactgctctctctaatcaaagcctgagtacagcacagaacctctacctagctctgtcacagtgtggggctgatcacaaaaggctgagagcaaaggtacagagagaaagaatattaacctggaaagtaagaaacctggtatgctatggtattaaatatttagtaactataaataaaaaggaggaggaaaaagcaaggtgatactgtcatgagagaattatccaccttttgtttaaaaaaatgcaagttccattaattagtaagtgatttgtagtgagaggctaaaatcctgagcactaagaagtgacttgagtgaagctgaaaaggttttgcagcagtcatggggctaaggagtcaagtgattttttttattttttatttttttttatttttttagctattaaagaggacagatcttggtaaatacccaatgctttctgttggggtcacagaagttctataccatgcaagtcatggtgcttgggaaaaagaccaaacctccctcaaatgtaaacccagtattgaaactctgattggatttaggtgatctgcccttattttaacagaagcaaaagcaaatactttttttagtaatgtaactttatcccaagcctctataaattttttcatgcacagtgttcagtagtcacttaataattaccatgcatagcagggaattcctgggtattagtgatggcttatttctttatttgtatgttggcttaccctttgaaaatttatgttgctattcatatgtgatttgcacacatttttgtatttaaagttaaataaaatttttatttaaagacacgtacaaagatggtcagaacatcattatatagtcaaaatctggaaacaacccaaatgtccatcgatagtagatggttatacaggattgtgttttatatatgcaatggaatcatatgaagtactgagaatgtacgaactactgctataagtaataacatggattaatttcatgaacctaagtttctagaacataaataacacatactatatgattccatttatataaacttcaaaaacaggcataatccctacatggtgataaaaattagaatacgggtcactttgaagaagaagatcgaatagcgacagaaatgatcacaaagctgagcttctggagtgctgattaatttctgttttttgttatgagtagtggttacataggtgtgttctctatgtaaaaattcattaagctgtagaattattgtttgtgcattagtctgtgtgttatattttcttaagattatttactttaaaagatgcacacacacaaacatacacatgtgtgtcgatatatgtaagtatgtttaaagaaattcaagtgctacttgactagatggaatccagatcatttcattttcctcgttacttttatatattttctaaatgttctcccaaaaggctaccatgctttcatgacaaaaagtattttaacaaatattatttctttaaaatttgccttagaattgaaagcagtaaagaagatgtgttttttacagttgcggtagttcccaatttgcctgagggttaacaagacattgaaatttacagcctggatccaaaatctaagaatggtgaccctggagtttgctggcttttcttcaaattgcctgaccccctttacaccagcctgtctttacctgtcaatccactgtttttctcatcctattctttaaaatttatattcatgttttcagagtattctgtatcctcagtttaagactgtaactcttaagtggataatgaagaatacaaccagatcactaagtaaactaagaagtcaaataacaattccataattttgtgctaataggggatgatatttatgggacatgcaggcattttcttcatttcttactgaattttatatgacatgaaaaaaatccatgtcttacagaaatgtacagtcacatctatacatagaataatttccagtttatatatttcttgaagttttttaataccacttgcttcagaaatacttatgtaaaaatgaggatttcagggctatccattaggtctattgactattgttctgaacctatggaaatatttataaattagttaggtgtaaatcatatttatttaatttttcttgattggttcagaaggatggcaacaatatgcttcaatgtggatctgtgccatagagaatgtttatgtcttattaaggaaagacttcttttcattgttcaagcttaaaaattagcaaatgaaaacagatcactttaattaattgttaggaccatatgtcattaacacatgttcacaattaattttaaatatgaatatatatataatgccagttaaattaaaaagatctcaaactaataaacctaataaataaaaagttacgtattttccatcaacggagtttgctcactgattatttcctcaaaagttgtattaacttataattccactagctggaaatacttgcatgttagtactaaatactgtaattgaacactttcatgttcattatttaatttaaatgtgtcttagaatttccttttgtaatatcatagaagaattttcaaaatatatgtctcattctcaacaatgcaagatatttctgtttttgtttgtttgtttgttttgagacaaggtatcactctgtcattcaggctggagtgcagtggcatgatctctgctcactgcaacctccgcctcccaggtttaaacaattctcctgcctcagcctcctgagtagctgggattacagacatgtgccaccatgcctggctaatttttgtatttttagtacagatggggtttcactatgatggccaggctgatcttgaactcctgacctcaaacaatctgtccgccttggcctatcaaagtgctgggattacaggcgtgagccatcgcacccagcttactgttgtaatttgaatacacatttatttttataaactagtatggctctgaaagaaggatattaatatagcatctttttttattttcattgttgttgttttttttgagacatgtctcattctgttgcccaggctggagtgcagtatgtgatcatagctcacagcagctttgaactcctaggctcaagtgattctctcacctcagtctcctaagtaggtgggactacaggtgcacgccactatgcccagctaatttttatttctttattttatttttgtagagacagagtctcagtatgttgcctaggtggtctcaaacttctcatctcaatcccaccttggcctctcaaagtgctggggttataggtctgagccgcgatatccagctcatcttttgttttttgttgttgttgttgttttttaatagtataaaaaaagtgagttataaagccatagtcaaagaaagtagtgtaaattcatctatcaatacacaatgcattatttgaaattcgtgagaacatacattaagagtatcttatttattctcttctagtatttcctatctcaggaaatgacatggcaaaataattaactaattttctaagtcactttatctcatacatgcaatttattagtcaccaagtcctgttaatttgaccttgtaaatgcgccttgtattatacagttttgagcaatggataaataatacaattttcatttcctgagtaaatagctggaagtcagataactgggttttctgattagcatatgtttagctatgtaagaaaaccagaaatgtgttttgctcaataatttaatgaataatttttaatacattttcttgttaatcaacttaatgaacacttttaagggcagtgtgtaatactacgaatttaataagcaattttggctttaatcctagagaggataagagaagggatgtttgttttttatttaatcacaaaaaaatgcatttttttatcatttaatttttacatcttttgacacaaaatttgttaaacatttcatggctagaaaactatttctttatattttgtgtgcatctcatagcacagccatttgttttgtgctattacatttatattagatgattgaaattcaatgacattcaatacatggtttaagaaacatgtatgcttagaatttatctgagcagagactcatggtatgtataggaatcagtcaggaatatttcaatttgttcattaagaaagcagaaaacattatcagaggtaaggtaacactataattatggagcacttatcatttatctatttcttaaataaaaacatgagtgtttaatttcaaaggtgcaatttcttttctatagtcaacaagattcactatatattctcagaaataataaagacattattttattaagaaatgtgtctaacgtgtttactaatagaacacacaatgtcagctcaatgaatatttttagatactttaaatatctatttttattataatttgtactacatgctgaaataaattaccttataacttattttatttaaatgtctgaaaaaagaagagctagaaagaatattgaaaatttccatctgtgagaaaacacaagaaatgttatttatagaacacaaagttttcctatctgaataaaaatcttcactactatatctaaaattcttttcaataacaatgggacaatgaggatttatagtttagaattcaatcattttttgtttaggccaataaaacaagaaaaatacatattcaataataagtatagtatttagagaatattaatttaaaacattttcatccttaagcgcaagtcatcttgttgctacacagttcagagccaagccaacttcattcagattgtagagtttcattcatgatgtagagtggaggtccttcctaccattaaagattagccaggaggctttctttccttctgaaggaaaaaaatatacataaaatctagaatttctttgagaaagagaaaagggaagttccttctattatgaattacgggaaggagaaagggagacacagaagagacatgaaggcaggaggcagaggtcctcctcctcatcccctactgccactttggacccctccttaagtgaagaggcactggagaaacattttggaagaagggggaaatgatgactgggaaactaagagaaatttgggtgaaataatcacagtagttttcaggagtatgtaagcctccagaaaatttccacaggttccatgggaggtcccatctaataggttatggcactgaatatacagcaatggcagagagaggtgtcaagagagagaagccatactaccagcataaaggactggtaaatacatgttacatctagaccacaattttagaatgaagtcagggaggagaggtttggttggcagcttaactagtgagtatttatattgtcttaaacagataatgctgaaatactgttctaagaaacttaagtgtgacccagattacatctattccctacctgtccaaacacatatttatacattattgtctaagtaggaagattgcatcaggtataaaaaataaagaagcttttttttctctgtgcacatctgagtgtagtgtgtaaagattatatatgtatgtgtgtatgtatgtatacacattttatgcaatcgtgcatgtttttatataaatatatattttcaaaaatatcagaaagtatttatagtatacctgtatactatagtatatataatatagaactatagatataaatatttatatatttgtacataaacattttgcatgttacatatattgtaaagattcacatatatgacttaaatgtttaaagttttactattctataaccatacgtattgtgttctaaaatattaaatcaactattttgaaattcaaagttactttaacttcacacattttctcacgcatgtatttttgcttttgttaaagtttcctatttgattatgaagttaaatgctcaacttttaaatgttaattgttcatttatattgccatgtttcaaagaaatttaggaaataatattgcttcaagacaaaaacaaagatgctaagtcttctagcaatctgaaattgtgaaatattacaagtgttcagactgaaagccataactgagtaattcaatccagtaattcaagagcattttacagaaatcaaaccatgatggaatcaagttacctattgtatcaattaaggaggaaaataatattgctgaacacacggaatctggtcagaaatatctaggctacagaataacttcacattttaaatgaaaaaaattactgatcactgttcgcatatttatttatatctttcactgtgttattggttgattaacacagctgcaatccataagccctacttcctagctatttttctacccactgttgctacttacagataagaatatctaaaaggaaatctgctagatggggtttctgaaaaaactttggtgctttgttaaaataaagcaggggtgcagactcttctggcattcatctttatactttgtctggtatagagaattgacgtctagagttgcagaagatgggaatgaaagtagacaataaaaatggcaaagcagaaaatagccagcaggcatcctcaatggcactgatgtgcacctgcaccatctcttcactgtccacctctagattttttttctgtatttgtttgtactatctcaatttttaaatgtaaaatgttgtggtattaagtatattcatattcttgtgcaaccatcatcactatccatctctaaaactcttttaatctagcaaaacaaaagctctataacattaaacaataactccccatttctcttttctttatcctctggcaaccatcattctactttgagtctttgtgatttttgaccattctaagtaccaaaatataagtggaatcatatggaatttaacattttgtgactggctaatctcacttagcataatgttctcaagatttatctgtgatatagtgtatgtcatactttcttccatcttaaggccgaatgatatttcattatatgtatataccacattttgtttatatattactctacataaacatggaaaactgggttgcttttacatcttagctattgtgaataatgctgctatgaacatgggaatacaaatatctcttggagactctgctttcaatttttttgatatataaatgaaagtgtgattgggggctcatatagtaattctatttttaattttttgagaaactaccactgttttccacagtggttgtaccattttacattctcaccaatagtgcacaagggttccaatttttccacatcctcatcaacatgttatgttgttgttgttgttttgttttgttttctgtttgttttttataatagcgtctctactgggtgtgaggtggcacctcattgtggccttgatttgcatttccataatatttagcaatgctaagtgttttttcatatgtttactggtcatttatatatctcctttggaaaagtgtctattcaagtactttgccaattttgaatcagtttgtttatttttgttttctttaaaaaattctcgggctgggcgtggtggctcacacctgtaatcccagcactttgggaggctgaggcaggcagatcacgaggtcaggagattgagaccatcctggctaacacagtgaaaccccatctctcctaaaactccaaaaaaatagccaggcatggtggcaggtgcctgtagtcccagttactcgggaggctgaggcaggagaatggcctgaacccgggaggcggagtttgcagtgagccgagatcgcgccactgcactccagcctgggtgacagagcaaaaatccatctcaaaaaataaaaaaaaagatctatatattttgaatattaatgacttatcatatatatgatttgcaaatattttctcccatttttatgttgcttttttattctgtgtctttgacacccctttacaaaatcacaaattccaacttgtctattttttgttgttgttgtctgtgtctttggggtcatagccaataaatccctgacaaatgcaatgaaatgatgcttttgccctatgttttcttctaagagttctatagactcagttttcattttaggtcatgaatcacttttgagtttgtttttgcatatgatgttagataaggtccaacttcattcgtttgcatgtagaatgatcatagcacccatcttaaaaattatctgaccaattaagtgaaagtttatttttggattttctattaaattacattggcctgtatttctgtttttatgctagtactactctgttttgagtattgtagctttgtagttagtttgaaatcaagaagtataagttctccagctttgttatttatttttctttttggctatctggggtcccttgaaattttaaagataagttttagaataagtttgtttttttaaaaaaattatttctacaaataacatcattgggattttaatagaaattgcagtaaatctgtagattgcttgggagagtattaacattttaacaatattaagtcttcccatccatgaacatgggatatttttcaatttagttatgttttatttaatttctttccaaaatgttttgtagttttcattatacaagtcttttatctccctggttaagttaattcctgagtattttattcttttggatactattgcaaattgaattgttttcttaattaactcattcattttcaatctatgaaaatgcaaatgattttgtgtgctgattttgtactctgatactttgcaaaatttcttagttccaacatttgtgtatgtgtgtgcaaacatgaaacatgtgtatggaatcattaaagttttctatatgcaaactcatatcacctctaaacagagataactttacttcttccttttcaaattggatctttctctctttctctctctctcttttctttctttttttgcctaatagctctggtgaggacctctgatactatgttgaacacaaatggtaaaagtagacacccttgttctgaatcttcaaaaaaaaattagaatcgaaaaagtatagttttatctgtacccccgatagctaaaaaaaaaataaattacatgacacatgcaacttatacagatttttcaacaatcattaacaaagaaaatttagaaaaggacagtcaaatcaaacttcctccatactgtctacaaataaactcacaatgaccaatagaatgtgacctcttatctccatcatccccattttgagatggtagaaaacgtgtattctcatgatcaaattttcaaactcatcctggcaatttgtttcacacaaattgcttgttaacattttcatttcaataaattccatccatctgtctgtgtttattaaatatctgttttaaaccacatgattcttaagtttaaaaggttaattttactgtaattactaaatatttagataagaaaagtgctattaagacgtgagaatattattgttatataatcactttttttcttcaggaacccactgtgtatgcctacatataagtatatccgtaaaattatataaatgatggaattaactgaataaacttttgtttgaaatctaaatgctttctactctactgatattctcattacaaactttacaaatgaacacaaaatttactcagaaaatcagaattttaaagcaaaatgaaacctgagtgattatatgaggaaacgaggacctagaaatgctaagtgtcctgtccaaggagaattaaaatatacaaataaattactgaacaatgaactagaaagaacaaaactactgattttagcccagaacttattttggttttaagtagtcaaaagtattattagtagattgtgactattttccttccatctgtttccttgtctaagaaactttaaggacagacttaaaatgttctagctaatattactgccattagtttctgatttataatgtggcatatttcaaagctatgtattatcctttctttttttcctattttattggttgacctgaatgctttcttaatttcacttcactgtaattatacctcttaatctatgctaaataatttctccttctcctccttagaatattttctctcacttattgcctagccgagttaccctctaaactttcatcataagtcaagttcttcaattacttcctccagaaactctcactgacttctttacatacatctaacacagacatactgtaataatttagggcaggctgggcgcagtggctcacgcctgtaaccccagcactttgggaggccaaggagggtggatcatctgaggtcaggagttcgagtccagcctggccaacacggtgaaaccctgtctctactaaaaatacaaaaattagccaggcgtggtatcatatgcctgtaattccagctacttgggaggctgaggcaggagaatcacttgaacccgggaggctgagtttgcagtgagccgagatgtttccattgctctccagcctgggcaacaagagcgaaactccatctcaaaaaataataataataattaggtggattgcttatataaaaattagccataggttttatttacttttctatcatctaagtacctattatcctcactgtttactacaactgttctgtatattttattatatgtataagtatgtttatttatgtaatgtctgaaaaatgttaaatagcttactatggacagactgcaattaccaaatttaattatttctatttatctcacttttagttaagatgagaaaactattcaggtatcaattttatatttttattataataaaatctcagaaatcctcctaaaataaatgtgaagatacatttattttacatttattattacaataataaatacattattattgtatactttcagccaatgtagtatatagattaaatagatcatttcaaggagccaggagatatgttgatatttaaattgagtgagccttgcttatcaatctgtaatgggtttgaaattatttctagacaatagcactgagttgacacataagcacctgattgaaaaaaaaaagagaatcacctaacacatggcatagaaatggtgaaaataattattaacaatggtaatattacaatacatagaaagcgggatgctggcagttgtgaatgagatcgttcaaataacacagacaagtgattttaaagcagttcagaatgtctaacaattttttttttttaaagtgagttttaggtccaaaggaaatagaatttatcttctttggaattataagcccatttaaattatttagataaccaagaattacttatgattcttactgctacttacaaatgcctgtggaaacaagcaaatcactttcctaagtgcttaaagatatttatccacaaaatccactcttcctccctgacccttaaaaaaatgacgctaagtgtaacaggttccaacataataaactgccagaacacatttcatggtgcagtgcaaatgacagacacaatggaatacctgttagaataaagtagatttcattttccctacaagttaggtgagaatgctgatctcaagtatctgttctgtcaagtcaaaggttgcagcacaatagcaaattcagagtataggtgcatgtattaatagcctgttgaagaaaagagcaacacttctagtaattataagaagttgctccagatgaaaaacattaattcatgtctgtgatacattgtttaagactctctcagttgccttaatactatttttaaaaccccttcacagggagcatactcaccccatctggcctgccatctgaagctgtgatgatcagaatgtagcgatcagtgctttccctgtccagtgctttccctaaggttagaatccccgtgctagtgacaaaacaaacaaacaaataagacaaaaagagatattatgtcacaaggagagtcttcttagtatagtgaattacttttgatagctttttttcccctctcagtaatcacagcttgagtattttagatgtataatactaagattcattctgaaaattgaaaacagcttttaaggctgtcaaatttcttagcagtatccatgaaactgacactgagctgatttcctaccttccaggaaacaaaacataacaaaactgtgcttaattcattccaagaagaacagtatctatcttgttttcgattatttcaagagaaaagacttcattattccttagcagtctcagaattctttgaaacaaggaatggtttcctataactaatgtatatcacctcccaatttatgtcatatgtatgtccattatgaaaatgcaaaaacccatctaaatgttatctctgacaaactctatggataaaagtttttcttttttcttacttttaaaataacagagacccattgtacaaaattagaaaatagaattttttcaaattacagaaattatgttttttgtaatgtttctttttgtactttattataaccacatttaaatatatgattgtttcagaagaggaatcattctgcatattttacattttttaagaaaatataattgtattagaattcatgttctcattttataatttgtttaaaaccccttttgtggctacactaacaattttagtattttgttattctttggaaatttagctgtttcttaatttaactgatgtataatgggagattaacagcacttgggaaaattattgcacttacaatatttttaatacctactccttatcttttcactgctcagaataaatgtttccaaatatttaagactttattcacccatgtaatttattttataacagtttggcttgctctctaatgtaggttctacatttatttcttaaattttacatctgatattgtacacattttaatcgagcctaacaagtatccactgtgtagaagagtttatctgaatataataacacattaaaatatatgtaccaagtccaaaacataaattgtttctaatggataaaatgctttcattttaaggtaagtgcttttattgtaaagaaaatttaaacaattcatatcacatatggtagttgagtacagagagtcaaagccgatgaatcaaaataagaatcacagttactcaatttgcttattatgttgtaatggttgacgtggactttttaaaaagttctgaacatatggcatgcccatgaaaaactgactttgcttcctgtacattttaaaaatgttttgtcaaaataattgaaaaccagttcccagagcatgttcacaacaattaagtttggaccagcttcctacagtacagaaggtccagataatcccattttaaaattacattaaatgagaaaagtaagacatgtatttcttctgaggcttattcacaagtatcttaagaaacaggaaagctgaaaacctagccatggtataataagagaaagaaagaaaattgagttaccattttcattttgtttcttccctcagttaattatctatattcctccttgtacattaaattagaaaattactaaaaagtatattgtatatttacgatgaattacaaaactcacgtgataactgagttgatttcctaccttccaggaaacaaaacataacaaaacttcgcttaattcattccaggaagaaaaatatctatcttgtttttgattatttcaagagaaaagatccattattcctcagcatgttcagaattctttgagacaaggaatggtttcttataaataatctatatcgcctcccaactgtatatagtatttggaatatatatgtatactctatatatactatttaggatatataatactatatgtattattccaaaaatactatatgccgtgaacaatatagtatacagtatattcatacttagggccattttaaacacaaacagctaattgtctatggtctggtgattattatagaggtagtttttatgtaatacgcgggccttgcgactcagtgttgtaggcagttgtgtggtatatttgggcaatgcagaaggggagaaacacaggcagtgtattttgggattcatagctgaaagactagtttatgggtttacctgtgcatccttttattaaatccgagaaatagctcacaaaaagtcttattaccagctagatggaggctatcaggccaggatacattggggtacacttagtaatgcaatacaccttataagttcacatattaaaaatacataagcttcttcaattgataaagcatcaataacactgctacttatacaggattgaaaatacatttcccaggagtgatgtcagtggaaatggagaagacagccccaagagatggtctcgccacaaaacgtcaaaaaatcacaattaagcagggaccttcaacagcaaatttgatgaaactctggaaaacagtcacaggtttatagcaaccagatgaaggcagaatttgttttaaaaaaaggtaaatcaaatctggtagaagaactctgtggcattttgacttgtctttatcctaccatctcactggctcagagtggccttgaaaacatcagtgaacattcccagtgtgacactatggtctttgtttctggagggagcgagctatccttattcataaagaactgtgggggtctattctagtctgtctggagactgcctgaaggagtgattcatggcacttatctttgtttcatcaaacttggaaatcactcaaagcagaaaagcagtgggcattcctcagaaatattgtaaggcaggggatagcccacaaacacttgaggcgtataatagagtgccaaaaacttgccaggaaagtctgggtaaatagtttcatggaaaattcaggcactcaaaagtgtactggggaatacagaataataaatataattgagaattcataaatatacccacacatctacagtcatctgattttcaacaagaatgccaagaccattcaaaaggaaagaatagtcttgtcaacaaacggcactggaacaaatggaaatctatacgtaaaagaattaagttagactacttcacttcatacacagctattacctcaaaatggatcaacaatttttctaaacacaagaattgaaacctgtaaacaactcttagataaaaactagaggtaaatattcataatcttggatttggccatggattcttagatatgacaccagatgcacgggaagcaaaggaaaaaatagatatactgaacttcgtcaaaataaaaaaaaaaaaaccttttgtgcatcaagggacattatcgagaaagtaaaaaaaacaacgcatataactggagaaaatacttacaaatcacatatctggtaagagtcttatttccagaatatataaaggattacataacttaacatcaaaaagaaatcccaatttaaaaataggcaaaagactcaaatacacattttttccaaagaagatatacaggatatacaaataatcaaaaagcatatgaaaatatgtcattagtcatcaggcaaatgcaaatcaaaacccacaaccaagtatcacttcacactcactatgataattatatttaaaaaaagaaacaaccaccattactaacaacaacaacaaaaaataattgttggcaaaaatgggaataaatcagaatcctcatatatttctggtgggaatataaaatgcttcaatcactgtggaaaatatttgacagttcctcaaatggttaaaaacacataattacactattccctagcaaatctattcagtatatacttaaaaaagccaaacacaggtacttaaatacacgtacatatatgttcacagcagcggtatttgtaataccgaaaggtagaaaaacagcttaaacgtctatcaatttatgaataggtaaacaaattgttgtatatgcatgtaatggaatattacgtagccatgaaaagtagggacctacttgcacatgttgcaagacagacgaatcttggaaacattaggctacaaaaaagaagctagacacaaatagtcacacattgcatgattccatttctgtagaatattcaaagtaggtaacttgatgaagccagtacgcagattggtgtttgccaggggctaagggaaataaggaatagggagcaattgctaaatgggttcaggtttctatttggagtgatgaagctattttagaactagacagagttggtaggtgcatgagttctgaatctcctaaacaacactgaattgttcactttaaaatggttaattttgtgctatgtgaattttgcctcaattatataaattatattgcagagtattttccatcaccaagcttttgggctacgttcctgaaacatattatgcttggcatactcaattattatagaaaatagggtttgcctaactataaaaatggtgttcaaacataatttaaaaatttggccaggcgcggtggctcacgcctgtaattccagtactttgggtggctgaggcaagaggatcacaaggtcaggagatggagaccatccatcctggctaacacagtgaaacactgtctctctctttttttttaatgtgcacttttttttttttatttttttgagacagagtctctctctgttgcccaggctagagagcaatggcatgatctccgctcactgcaacctccacttcccaggttcaagcgattctcctgcctcagcctcctgagtagctgggattacaggttccctgggagcttatttaaaagctctgtgccatcagttttcccttctgtcaaatgggaaagtgaaaccccatctctactaaaaatacaaaaaattagccgggtgtggtggtgggtgcctgtagtcccagctacttgagaggctgagggaggagaatcccttgaacccaggaggcggaggttgcagtaagccgagaccataccacagctctccagtctgggagacagaacaagactccatctcaaaaaataaaaaaaataaaaaaataaaaattatcacctgtagtcccagctacttgggaggctgaggtgggaggatcacgtaagcctagacttttgagactagcctgggcaacagagtaatacccagtcttaagaaaattcaatgatgtaaatagaaagtagcagaggatatctacttccaaacaaaacaagctaccgaatttaaaacctgcttctataagtaactgtttttcaaaattccgttattaggaaataccgatgcagcatcattataaactattatctcacatatttcatgatgtataggctttgcttatttaaaattttgttaaaaattctacagcttgtgactgaacatttacacttggaggtgtctgagcctttgacagatttatcacattgcttttgggcactgagtttcaggctttacaatgatatttaaagagattagagtatactttaaaatgtacagttgcttcaagtttgacatggcatttcatattaaatagcaattagcaattaacaaaaacctactaataaagggagctaggtattgacagcagtttggggaaaagatgatggtggcatgaactaaggtagtagagtgaagtgtgagaaatagtttgatttgggtttaatattttgaaagtagagctgagctgtcagggaataaaataaatatctttcttatatattatttaattttcaatataatcataaaattcaaactgatatgaaaaatataattgagcattacatgtaatgtcaaaacaaattaatcaccaaagaaaaaattaaaatgcaagtgaagaaaaaaaattttaatagaatttggaccagagatggagataatttttgaaattctcttatttagcactgattttaagtgttggcatcacagaccccatgcttcagtgataacaatccataaatatttgagagatggcatttcctcaacctcccttaataaataactataccattaggccatcatatttataagggaagttgccatatatcttatttaaatgtgtacttatttgtggatgattgctgagtgaatatttgctaaatcatatgccactatcaagacagacactatgaaaagatactagaaaaatgcattatattagaatcatacagatatggccacttaatacatgacactgaatgatttgtattaccaatgtttgtgatttttaaaaaaccaaggctttttctttaaagacccagtttctttcttggctgtgtgactaagccaatttattaaaataataattcagtactttgtaaaaccctactgacattaagatgattattcattactactaattttttaaaagaaatacaagaaaattttggcatacttttatttcattaaaggaaagtaatggtattataatgatgcgtattgagagaatttgcattatagcataaaataatatggtatttaaagtatacaatagacatgtaaatattttttcattttgctttaagatataaaatataacccaaatagcatatattgaagtgtctgatgaggtagaacattgtttatttttttagcgtacctgtcttagtccatttgtgttgctataaaggaatacttatggctgggtaatttataaagaaaataagtttatttgtctcacagttctacaggctgtataagaagcatactgccagcatctgcttctggtgaggggctgagagtacttccactcatggccaaaggtgaaggggtgctggtgtgtgcagagatcacatggtgagaaaggaagcaagaaaggaggggtggtgccaggctccttttttacaaccatttgttgtgggaactaataaagcaagaactcattcattacctctggtaacaagccattcataagcggtctgcctccatgacccaaacaaatcccattaggccccatctccaacatgagggatcgaatttcaaaatgaggtttggagtgtcaaatatccaaactatagcagtacctggattgttcatatccttgaaagttatagagaagtggtagtgcaaagttttgaacatgaatctcagaagtttcaaagaaggtggcagttgaaatgtcagttattgttctccatttcaaatgcattgaaatgtattgctagtggttcaggctactctataaatatcaatgagaacaacagcattgaggtggtggaaacaaagtgaccataggatagaaggcaaagggcccagtgtacaggaccctgaatcaagaatgatcatcaaaagggatcacacaaccattatagggacatgttctgctttagctttcctggaagcagtttgtgtcttaaggagatgtctgtccaggttgacctaagagctttaacattaagaatcatggtcaatttagactaaaaggattttgcattgacataatttacacctttaagaacctctgtgacccagccattatctttttcattccaaatgcagagatgagaggagcactagagatataggaaagcagtgcatttagataatttatttggcaaaactagtagctcactggatttcacaatcagcaattgaaaaatctcttggcatcaagggaaaaacaggaatagaaattcttaagagacctgggcttcctgcttaccagagcaggtgaaaacttcattgttgtctttttcttttgttgacagctttgttaacattttaattcagatatcataaaatccaccaatttaaagggtacaattcaatggtttttagcataatcgcagagttgttcaatcatcactgtaatcaattttagaacattttcaacaccatatctattaacagtcactccccattctctcccactcctcattttcaggcaatcattgatcaactttttatcttatagatgtgcctattatgaaaattttatagaaatgaaataatataatacgtgctctttttgcaactgacttatttcacttagcataatattttcaaggttcatacatgttgtagcatgtttcagtacctcattaccttttattgatgagtaatattatattattacagacaggcaacattttgtttattccttcctctgtagatggatatttgacttgtttccacttttgtaccattgtaaataattcttttatgaactttctttgtgcaaactattatgtagatgcacgtcttcatttctcttgcatatgagcagaatgctggcttatgcggtaattctgtttaccatttggagaaaaggccagttctccaaagtgtagtcatagtttgaatccatgtccttgcccaaatctcctgtcaaattgtcaccaatgtaggagataggacctgctggaaggtgattggctcatgggggcagtttctcatgaatggttgagcaccaccctccttggtcctgctctcttgatagagttcaggagatctgcctgtttaaaagtgcgtggcacttcccctccctctctcttcctcctgctcaggccatgtgaagcgctgactccccgctttgccttcagtcatgacttttaagtttcctgaggcttccccagaagcagagcaggtgccagcatcatgcttcctgtatagcctgcagaaccgtgaggcaattcaacctcttttcattacaaaatactcagtctcaagcacttctttatagcagtgcaaaaacgaactcacacatgcacattttacatggccacataaatttacgcagatttcagtatctccacattcttagtcatacctggttttgcctttctttatcactacagacacaaagtatgtatgaagtcaaatctctttacagttttaaattgcatttctctaatgacaaatgaacagtgatcgtgatcatatttccatgtgcttgttggccattcacatatccttttttaaagaaatatctattcaaatattttgcccattttaattagattatttctctttattaagttgtaacagttctttatgtattcttgagacatgtttcacaccatatacattattttaaaatattttctctgattgtaggttgtttctcactttaggatggtgctccttgaaatacatttttaaaaattgacgagacccaatttatcaattttatcgttaatctttgtgcattttgtgtcatatctcaaaatgtactgactaatccaaataatgaagatttacttctgtattttcttctatgtggaatgcagttttatctcatatattgcaatttatgatccactttgagttcatttttgtgaatgatgtgagataaaaattgaaattcattctcttgcatattgtcccagcttcatttgttgaaacaaagttctttcctgattggattatcttgacccctttttgaaaatcaattgaccataaatactagagttatttctggattcttaagtctgtccaggtgcttatatatctatctttatgctaatactacacagccttgcttaaagtttttaacatttttattttctttaatgatgattgtaaattgtagctaatttttgatttctacatccctatgagataaaaatgaaaacagttaaggctttttatttttcaaatagaagtttacttatctgtggaaaacactgttcttgtctatagtttcccaggcattactaactcatgtttgtaaaattctatttaacgtgaaatttcaggtatttctgggaagactaattgaccagcacatggttctcttgttttggcattatgccccacatgttcctgagtctgatgtggcaatgtattcatttgtcaaagttttaactttataatcattggccaagtttacatttctattccttctgaaagtaaaactattcacaggtacacaggaaatatcagggaagagccaagctctttagaaaccagccacatgtgacagcagaacagctaccttgctattgcaaaagggaagcatacagtctctctgaagccctaaatgcctccttttaatgcctgctcccagttttctcaatagttatcattagcaatatctcagatgtattcagagagataagtagaatgacactgatctagacctcaaagaagtttggcatgaacacgtattttatttcattgtgctttttttcttaaatatacctatgttaatctgaaattgaaggatgtgtttgtaacacatcttgcctacaagcctccctttgaatacacagtttggtgctaagtaaccctttgtagtaatgtccttgtcattatcagtagctgacaacattaaaaggatctaattaatcccagttgtgccttccaatgaaatgtttccacctcagtagattttacctagtaaaaatgttaaaaataaacagtctcctgggtaatatttctgggctcagaattatcctcccagctaccattagcattcatagaaaacagaaagggaagtacaactacaaacagctgaaagcctctgattagaagtctgctttcttactaacagtacgttgctgtacatttttttaaagtaggaaatcatttttaacttacgtttctgaaagattaaaaactctctgaggatctccattctcaatggcatatgttattgagtctccctctcgatcagttgccttcagagagaaaacataattcaattatcaagtaattgatatggcgcccactcattacagagtaatataaaagcttgaaactaatagcacagaatgtccatgacactgttaaagaataaagattaaagcatggcctaatggcaaggtgtaaaatcaaacatttcgtatctgatccatttctgaatatgtaatcctacctgatgtggaaataatcattttcccaaggtttacttatttaattaacttaattaatgaatttaatttcaatgtctgtttataatttaaataaaagctgctggctgggcacagtggctcaagcctgtaatcctagcactttgggaggccaaggtgggcggattacctgagatcaggagttcaagactagcctggccaacatggtgaaatcctgtctctaccaaaaacacaagaagttacccgggtgcagtggtgcacacctgtaaccccagctacttgggaggctgaggcaggagaattgcttgaacccgggaggcagatgtttcaatgagctgagatcatgccactgcactccagcctgggcaacagagcaagatcttgtctcaaaaaaaaaaaaaaaaaaagtgctaaactatgtttacagtgtcgataaagtgtttaatgtatattcttttctttttctgttcagaatatatcaagacaataattcaaatcagtctaactttctggttaaaaatcctgaatttatagccacaaagcatgacttcaaaaccgggctccaattgtcctatgtgattatttctgtgtatccatttctaaaacgaggactatacaacaatacaaatgttaatagatgttgagaggtttaattgaaataatatatatcaaggcacatagactaatatctggtacattgtaagctttcaataaatattaacctttttgttggtttttcttcccttcaacacccaagtcggagaagaaaacatatagtttgactttgagttccgagtttctcttgaccaaaataaagatgctcttgttttatggcactgaggtctggagttttaccttaaaaaacatcaaatcagttctttttccagtgagtcattcgatcctcttataaaagacatggataaagaaagaaatttggatgctatcagagagttgacagaatgatctgcctaagcatgatgctacagggggggatatatctgataaaggttcagatgtattttatttttaggtgactagcctggcagaaacaccagcctctccacagacaggaactgccctggagtcagcaggattctgagagaggaataagtatgtgagtttctgtcagtgactacataataactgtcccagccataagaggctgagtgtgaaattccctgtccagacaggcaggaacgtattgttcttagtggtagatcagttggctttgacatggattacacagtcctgctcacagaacgtccttatcagctaccacaatggattgatggccagaagcctctcttggaccacaaaaactacagaatcaagggaaactgaaaataatatttcagtcagtaataaactactgaatattgactatgtgctaggttctgtaagaaaatctttgcaagattatttaatctgtctctcataaaagtgatatacttccttcgcatggctcctatgacatcatattgtcctgctttcaatcctcacattatcaatggtagttcctcattttcctttgctgatttctcctcattttataagacttattttatattggattgttccaaaggttggtccttgaacttcacttatttagtcaactcattcaacagtgtagctataaatactgtctatctgctgaagacggtcatatctctaggctagccctttcctctggatttcagatgtgtatccaattgcctacatggatccacattagatgaataataataagcctccccaatttaaaaggttaaaagccccaaatctagatctcctttccatcttgacgtacctcaaaaaataaaagaaattcaaacaataatctattgttttcactgcttcatcatctcagtaagtacctgcaactccatcctcctactttctcagggctcatagctacactttgagggctcactcttacattccaatgcaacccatcagcagatcccaccagatttacctaaaatatctgctgtatctggctgtgtctgaatttcttctctgccaccaccttcctcatggattatggtagtaactattttactaacgtgttgcttcttcccttgtatcctcacaatagtcaattttcaattcagcagacaaaagtacttgtttttccaggccaattcttttatttctttggggtaaagtctattgctttctcccccagctccccaccctccccatgccatacacactaaaataaaatggaatcaaaaaaagtaaatgaagaagaaagtaataaattagccagggtaaaatatttttgaaacatcccatgttagtcaaaatccaaaattttatatttcattgagttagtcataatggaagcctaggagtagaaaaaaaagaagcaaacaaatttctaagaatacactcaataaaatggatagtagacgcttgatatttttcccttgcattctgttctttgctagataggaaccacaaataatgatactcagctaacattttgaagaatcagagaattatatctggagactatatcttaaccccaaaaagcttacagtgaactttttctgttgtttttctctcggtcaataaatttttcttattatgttgttatagatatgatcatgttcttttggtttgtttattgatatgtggttgctgttttaatttttttcttgagaaacattttataatcttgtgtttcataaaagccagaagaaatgcattctgaaacaagatagcttcatgtaaacaattttaagaccagattaatatcgaatcttttattatatcagatctactctaatatttaatatcctttatgtaagatgagaacactgtatttatatttattatttttatgttaattcctttcaatcccagaggtagcttgaaatatttcttcagttttatttgaccactcaaatacctcagtcttttaaggattgtgaatgtcaacaatttgcctacttcattcttatgtgaggttatgcccatattggaaactttgaagacttaggatttaaaagaaaattcttatttgattcctttcttcatttttatcttttcacacaatcctttattggtgttccagggtcgagggtggtataataattaggaagtatttatagtttttcagccaagaaagcaaaaggaaatggtgtaatctgtatcaaagttctgcaatctatgcattacatgagttagcacttgtatagacaatatcatctttctttgtcaatgtccaaaggtgagaaataatccataaaaagaaaaattggaaatatcaacagaagcatttacccttcaagtattaggatttgattatgtgtgtatatgtgccctaaacatatttctatcagcaatatttaaatgttttctatatataaatctaaccagccatctcaaaataattgcttataatgtgtcagaaactatattaaaattttgcatgtcttgtctcatttaaacctaatagtaactttactggtaaatagaaaatgcatatgacttcaattatattactatttctgccatcattccaaccagatttctctgtactttaattaattgaaagatgcatcttttttatctagagatagtaataactgtatcatcttgaaaatgggagcatagtgttattcagtattttccataatataagagatataaattgcttctttttagtgaaaaaacattttatgtgcttatttttgataaatcaagtcatatccgagtcccttcttcaaagcctgagaaaagtatgacagcagttatctttctggggcttattttgagtttaacgggggagattctggagccagctacctggattcagcctcagctatactatctcttctcagacaatgcactcaagtacaaaatgagaatactactactactacttaatcactcattaattcaacaaatatttattgagcatctacgctgtgttaggcactgaggctgcagcagtaaaccacacagacaaaaatcctgcccttatacaatttacatggtagtggaggaaaatgaagttaaaaattaattagaatattttgttttcagatctttatacgcgttgctcaactacaaaatatttcacaaaggacatatatggagagcagggtgaggatttacacttatagaagtgatcatgacagacttactgaaaatgtgaaattttggcaaatgcttgtaaaaggtgaaagagtaagtcacgtggggaagaacattccaggaagagggcagagcaagtgataaaggccgtgaggtgaaaacaggcctggtgagtttcaagaacaacaacgaggttgtcaggtctggaggcaagcagcatgtggaagaggagctcctcagtgtacttcgaccactttaatacctcaggttaaacgaataaatgatgtgtattttggatagctggcaagtaatgcactttagccactggtttgctaatatatggttaataacatggttaagattaaagccaatctttcctttaatttttatttaatttaatataattttaattttgcctgaagaacaaatgattcctttaaaaatcaaagcaattactctttccagtccactcaaccagattacttgcagcatctgacttagagtccctgatttttcagaagcaccaatagggaaacaaaagtatttatccaaggaagcagtgttcttagacactggcaaatggaaaatttggaaaagaaaacaaattttctctaaactaatcttctgttcatgttaaagatgaatacagccatcaaataccgtctgatagagtgcattttatgtgcaaggaatgattctacacatttcacaggacattaagacaaagtaactgcccttagggattctaaaatagataaaaatcaatggatttggatgattttctcacttaggcaaacaagttctgatttatgttattaaaccacttgagagcaacaaataaagctttcaattcagtacagcagtgtttcaaaaaatgtatacattcattcctggtattacattttttggcctttaacaaaatgttataatatttaaataaaaattaatgaatatattttattcatgtcaagtactgttattttgtcattcataatgataatataaaatgttattttgaagtaagtgtaagtaaaaggtcagttcattaaatattccaaacaatataaaatgaataatattatatagaatatacatataacatatatgaaacttggaaatgtagctaaatctacaatgacaaaaatataaatatgctcaaaaataaaagaatgttggaaaactgcacacaggagagccataaaacagctctttttcttacaatattggtatggattaatgatcttttgcccaggaagcaaaataaaatgccttatgctaagaaggcatagcagaatcactgctggtagtgttgaaaataaatggcatttggaagtgagcataaatttatttgtcacatccagagaagtgtctgtaaattaagaagtccttaataggaaaaatacctagacttccgttagatttagggatactctatgaaggcttagtcttaaaaaaattttgttgtacaaaatgggtaaccttggaatacaaagagatttaatcaattctaaaataagcctgcaattctaattttgtctagggctcaaggaacaatcaacaaaataaacttagaactaatgtaaatattcaaaatgacgcatccaaataatggttaccattatgtattaagcacttttaatatcccatctcatttaatcctcaaaacaatcttctctggagagcactacaatccctattttacacataataaaatcttaagcttaaaaattaaataatttgccaaagtttacaaactatagaatcataattcatattctatgccttttgaaactcattttctatcactagcaaagtcccctatgtcctaaacttatctcgagtttcccttcacctgcttgcttgaaccaacaccaagttcttcttaagaaccctaatttcccagtatcccttttgattggtgagcctcagagtagccttcttgtttctcaatgtcactgccagattattcttctggaaatgcatcagctttaattcttataccataagcattatactgcattaactgctactcttcattgttaaagtcatactctacactatttatcatacttcctgttttttgctcattgtcagtctctctctttgcctgtcattgctgtcattgtcaacttaatccaatatcaaagtttcaaataatatgtaaaatgctaatgacttcaaaattgtatttcagttctggggctgagagattcaagatcatggcactagcagatcccatgcaccttttgtggtctgcagacagctgtcttctcattctacacttacatagtagaaacagagagctctggtttcttcattccccataagggcactgaatgccattcatgaggactccactctcatagcctaagtatctctaactaccaaatgtcctacttctaaataccatcacgttggggattttggcttcaatatgtgaattttgggggaacacaaacattcagtccatagcagatgtcaaaaagtcttttcaaatacagtatggccaatattgaattactctttctctaacagtcttttaattttggctaatgacaaatcaatgtttccagttactcaagctgtatcttaatacctattcttaacttctatctccccttctatatccaattcattaacaaatcatgtagtttttaaccaccaaaatataaccagattgaaatgacttctcattatttctggaaagatcactccaggcctagaatgtgctgacagagcatatcaacaactctccataatttttcccaggcttcttccacagaccattttcaatgcagcatccaggattatcctttgttaaatttggttgattatgtcactgctatactcaaatttttaactgtacctaatttcgtgcagagtaattatatctatccctctcctattactgaatgatttcatctctactactgtctgtttcttttactttactctgtaaggaggagtatttttcttcttccttaaacatatcaggtgtgtctaaacttcggggtcttacctttgcacctgaaatacttttcctcagatacaaccatggctcatcctctcaccttattcaactatttgctgtaaggtcactttctttgtgaaataatcactatcaaattgtattttcccatgcacttcctctctagctttccttctttcattttccccataacatcttctaaaattccacataactcacatatattttgttaattttcttctctattagaatggaaccttcataaaagcagaaattttgtcttttttatttactattatatcctagcatttttagttgtgacaccataagaagttaatatttacttgtcatttggtccttgcaaagttataagccttaatgattacattataatgagaaaaatgaatgaaagaattttggaaaaatgaaaaaggaaggtattaagtggacacaggtctctccctgctcctgttttcactgggaggcaggaaaatgcacacctcaggaggggagggcatgggacattctggcttctccctgatttattagactgcaaggataaactaagtccaggaaactcagtcagagctctgttctgtatatgcacattcttcctcagtatcataaagggccttcctttgtacttcctatgactgggagcctaactttaatatactgaaggaagtacagcatttcaattgtatctggtacttgaagcaactgaatttacagtaaaacaaaacaaaacaaacaaaaaaagaaaccccacatgctttttacctattgtatatactctgtgtgtctctattaattgcttccaaacttgacagagaaaataaagttgtgtgtgtgtgtgtgtgtgtgtgtgtgtgtgtgtgtgtgtgtcctattctacattttcagaatacctgtcctaggttaaacacattccaaaagactgttagggaacagtttgttctgggcacactgatataaatatttcagttatctttatttataattattaaaaaatttgctatcaccttcatgaatattggacatgaatattcattgctaacatgaatggctcaagataaaggaggttatatgaataaactatatgaaaccaggaaggcttttgtcatctggaatgatgctgaaaagatgattccataagtatgaatttagcccaattattcttagtttttattgcccaatactaactgtaacattaccctgagagctgtctctagaatagtgtttggtttgcctaaattgaacttaaagaaaaatgttgtcaggcctctgaaaggacaaatcttacttgctaataaatatactgtgcatagtagtatttggcctgagacaaacttttccaacctttctatgaaggttgtgacagagaatcctagccctcttttactactacttattcgtggctattgatacttagaatctaattattgtggaaagacaattggctttggtcagtttacagccctcaacatttaatgacaaaccaaatagaaaaaaatcagaatcaacatttctgtcattaaaaaaatttcttcatgatacagctcttgtccagatttatataaatagaagtttatttgttctttgttttagaactatgaaaaactggacacctacgaagcaatttacttaaactcttagaatttagttcaaggttttctcaaagctttcctcagagcctactcacttttctaactagttagatttctcagccttcactagataaaaaccagatatgtaaaataataaagttatccggacacaggcaaacagtgaatgaaatcagtacacagtgaatggcttgacagctgtgagagaagtagacagaaagtgcaccttaaaaacaatagacacaggctgggcgcagtggctcacgcctgtaatgccagcactttgggaggccaaggcaggcagatcacgaggtcgggagatcgagaccatcctggctaacatggtgaaaccccatctctactaaaaatacaaaaaattagctaggcatggtggtgggcgcctgtagtcccagctactcgggaggctgaggcaggagaatgtatgaacccaggaggaggagcttgcagtgagccaagatcactccactgcactccaacctcagcgacagagcgagactccatctcaaaaaaaaaaaaaaaatatatatatatatatataaaacaaaaaacaaaaaaacagataaaacaagcatagttatcaaagatcaattgtccattaagccccacacatcacagcactacttatagataaaaatatgtaatccaatttaggaactattaatcacacaatattctgaattaaatagacaaaaacaaagcattaatttgatgcccattataaacaatatatgtactgctagaaatgagaaataatataaaactattcaatatagcccctaccttgagaaaatattaatctttgtgaaataaacattgagaaatagtgttcactatatgctggttaactgtgcatttgtaaaagtaatccaggtctagtatctacaagattaagaacctagtcttaattctctcacttttagccacctagggtctagggaactagcatgtatccctagacatctattctaaatcataaaatgaaataaaaaatacttcaagcatctactttatgtagtagatatagaatcagatgaggtaatagatatttaatacacttcagaattccattcaaatagaaggtattgctcagtggtcgggcatggtggctcatgactgtaatcccagcactttgggagcccaaggcgggcagatcacgatgtcaggagtttgagaccagcctgaccaacatggtgaaacctgtcactactaaaaacacaaaaatttgccgggcgtagtggtgtgcatttgtaatcccagctactcaggaggctgaggcaggagaatcgcttgaacccgggaggcagaggttacagtcagccaagatcacatcattgcactccagcctgagtgacagagcaagactccgtctcaaaaaaaaaaaaaagtattgctcaataaattaatttaatagttaaaatcttaggctttggagtgaaaagaaataggaatgaaatgggactctttcacttataagccacatcctctttgagcaagatttaaggtatttatatctcagtgacatcattctgatactcagataaaatggcacaaggctgtcatgatgatagaatgaaagagttcatatctagaattcagcatagtgcttagcatgcatttactaaactcttactattgatgttaatatttagaaagaagaatgcacaatagaattcaggcaaaaaaaatcgatttgtaaagcagtgtttcttaaagagactacaactctgttatcaataaaactctcacttctggaatactcagcaacatatagtaagtgatatgataccatattagcagagatagtacatcaaattcccggcaaccacttaaggtggggggggatttttttttttcctattcttagatacaaaaattttcatctgcaaggttacatgtatactttaagcactgcttgctcttcatgtccactttatatactgataaacagaaagaaagatctccagttaaggtctgaaaatgtgtctaagataggtagatattggttgatatggcttgtctgtgtccccacccaaatctcgtctttaattcccacgtgttgtgggagagacctggtaggagacaattgaatcctgggggcaggtcattcccatggctattcttgtgatagcaaataagtctcatgaaatctgatggtttgaaaaatggtagtttccctgccccagttctctccacttctctgccgccatgtgagacatgcctttcaccttccaccatgattgtgaagcctccccagctacatgaactgtaagtccaattgaacctctttcttttgtaaattgcccagtctctggtatgtctttatcagcagcttgaaaatggactaatacattggtcaactatattggcagtggatggtggggaggggaacataaataaatgtttataaacctggccatcaacactttgagctaaaaaaatgacaaatgagtgaaatacacaattcacaactaatacttagcatgtattattttgagcaaattaatagatcaaacactaacataaccccttagtatattttcagttgatacatatatcaaaaagtaaaaataagcaggattggagcatacagcagagacacttctccaatgacaaagtgaggagctacactgaccatctcccagtaaaacaatcacaactgctaaaaaagaaaccttaaaaattaaagtctcagctaggcgcagtggctcatgcctgttatcccagagttttgggagactgagaccagaagattatatgtggataggagtttaaaaacagcgtgggcaacatggtgaaactcatctataccaagaaaaaaaaagataagaaaattagctgtgtgtggtgttgtgcaactgtagtctcagctacttgggaggctgaggtgggaggataacttgagccctggaggtggaggctgcagtgagccatgaccacaccactacactccagcctgggcaacagagtgagaccttgtctcaaaataatattaataatcataatagtaatataaataaagttttaaaatagtctctaaatactgttctaaagacatatggcaagtggaaaaaatatttattcaataaaacctactaaatctcactaagaattgtgaaaactgttcttagtgagttcactaagaacagcctgtctttctccctttccaaaaacctattcagcacagcataatgcaggcatagtcaagaacatgggaattcttcctcacagcttcagtctgaaactaggctatctgcccatgaaggcaggccacacaatttcttatcacccccagcaatgtgctgcagtggctgagaagtctgatgtttccggtgggccttatggacaggaatggagaaaaaggcatttgccaagtcaatggctgtatatcaggtaccaggagatgtgttaatttgctcaagcaatgaaaccacatctggtacggaagctgcaattggagtcaccacttcattaagcttacaatagtccactgtcattctccaagatccatctgttttatgctcaggccaaataggagagttgaacagggatgtggtgattaccacccctgtagctttcaagtccttcatagtggcattaatctctgcaaaccatccagggatgtgatactgtttttgatttactatttttctaggtagaagaagctctaatggcttccatttggcctttcctaccataagagccctccagtcagggagccaatgtgggggttctgccagcttctaagtatgcctatgccaattattcattccagcactggggaaatgaccacagcatgagtccaaggacccactggataaccactataagacagatccgagctgaaaccccattaattatctgacctctataagcccctactttaactagaggaccacagttttgggtccccaagaatcaacgtcagctcagagccagtgtccagcagtccccaaaatgactgataatttccctttccccagtgcacagtgaccttggtaaaaggcccgaggcctccttggagaaggatggaagaaagattaacagcataaattggtgggtagtgtaatgggattcttcctcaaggggacctggcctccccttcattcaaggagttctgggtctgtaaactggctcaactctggaaattgactgaggggtcatgattctctgtttttataattcaaattagtcttttgtccattctacatagaagttttctgcttaaattaagtaggaatgcagtaggcttcctattaatttcacttctaggaacaccctgattaattagccaatgtcagagccttacatgagtcagactactctgatgctgctttgcctctgctgtccattatggtaactacacccaccttgcctttgatggttgagcgccaccacttggcccatgccaccttgggatccaattactcctattgtatttaaattttgtagttgagtgactgtggttcacactgtttgatctgacatacagagaagagcaattatagggctcttcaaagatgcaggtgctgccctcataaatctcttttgcaaagcactggtcaagggtatatcttcaggacccacccagcagggatgagtaggtctaaagtgactagtccactccaccatcccaaactccctaagcctttagatccctttctctgcattaaaccaagagagatccggcatttccagcaagctcagagttggctctcttttaatccatattttagctaaccagacaaataaattattataacctttttttaactcctgaagctgcaacattaaatgcagaatccctacttggtgggcccagatcaataaattcagcctgattgaactctatgtttcttccaccattatcccatacccataatatccattcccatgcctgttctccagatttctgcttatataaattaaaaaaacataacaaaacaaaataaactcgagcagttcttttcaagtgtagcacacttcctcatgggtcacactctgaacttacctctaggggcccacaaggactttagtctagttatagattcagaagcaaacaggagtgttggggctggctcctgaggagaatcaacattatttttcctggcaactgccttaggggaggccatcactgttgcttcaggcagtgcaaggtttctctcctcagacaaaagtggaaaggctgatggcagcatggattagagagaggaggtttccacgactaggaatggagaagccatttcttctgacaaaaaagtttcatcagagtttacaagctcagtgtccccagccttatcagggtcctcccacacatccccattccaagttgcagggtcccattcttttccaatcaatgccctcactttaacaggggacacctggcgaggctgtgattacacctgttgttgcaggtcagccactagcatgataagagtttgtgtctgattttccacaattttagctctttctctacaggagctaagactctcactcgggaaaatcttagcagatttgaggctcagtatctgcttctgaagccaggagttagaatccctgagttcagccgggcgcggtagctcacgcctgtaatcccaacactttgggaggccaaggcaggcagattacgaggtcaggagatcgagaccatcctggttgatacagtgaaaccccgtctctactaaaaatacaaaaaattagctgggcgtggtggcgggcgcctgtagtcccagctactcaggaggctgaggcaggagaacggcatgaacccaggaggtggagcttgcagagagccaagatcgcgccactgcactccagcctggctgagagagtgagactctgcctcaacaacaacaaaaaaaaaaaaaaaaaaaaaaaagaatccctgagttcatccttttctttcatcactttgtccagtaaacttaggagcaaccaaccaacttcatagtcaaaggtattatgtatagagtcactaaactctttgcctctcacaagtggtgaatcaggagtgtcaaatgcatttattttgcataactgtctaaataattcagagcaaggactatcattgttcaccatactattagaagtaaagtacttagcattttttgatctaatcatattaaacagccaactccagaaaccccaaaaccaatgaaagaactccatccttaatattcagttcctctagaaccactcctggcaccaaaatctgtattagtcagagttctctagagggacagaactaacaagagatatagatatagatatagacatatagatggagatatatatatatatatatatatatatatatatatatatatacacacacacatacatatatatacacacacacacacacatacacaaaactaataggatatatttaggagtttattaagtagtattaactcacacaatcatgaggtttcacaataggctgtctgcaagctgaggagcaaggaattcagtctgagtcccaaagctgaagaacttagagtccaatgttcaagggcaggaagcatccagcacaggagaaagatgtaggctgtaaggctaagccagtctagtcttttcacatttttctgcctgctttattttctgattagatggtgcccacccagattaagggtgggtctgcctttcctagcccactaactcaaatgttaatcacctttggaaacaccctcacagacacacccaggatcaatactttgcatctttcaatccaattaagttgacactcagtattaaccatcacagtatcatataacacagcaattccattcttaggtttctgctcaagagaaatgaaaacttatgttcacacacaaaaatatatgtaaatattaatagcagtattattcataatagtcaaaaattagagacaatccccatgaccgtcagctgatgaatgtataaagtgtagtatatgcagacaattgcacattattgagaaataaaaaataatgaaatatcaatatatgctagaccatgggcattaaaacgttaaactaagcaaaagtaaccagatacaatagatcacacattgcatgattacatctaaacaacatgtcagaatagacaaatttaaagacacagaaagcagactggtagttgcctaggactggtgactctggagtaaatgaggagtataggctttttttatggtgtgatacaaatattctaaaattgactgtggtgatggttgaacaactacgtgaatatatactaaaaacattaaattgtgtactttaaattggtagattttagggtaaatgaattatatcttaatatagctgctaataacaagcaagaattattccacagagatgatggagttagcacagcttccttgctgtccacactcagtagcaatctatttgttttcctggagctaatgagcttcttgtggcttacagacagggaccagagagaaacacagaaagtgtcaggtcatgggatgtcttaacacacaggtatcttcctaagggaaatgttaacataggtggatcctataggagtgagtctggtctttataaagcccaaaatcaagaaacagctaaatagaatggatatggaaagcattcctcctgttactgaagccacaaaagtataacgagcataaaaaacagacttgcttcaagtggtataggattagacaattaggttcgtacaatatgaagtgtggatccacacacataagaaaatttcacacacaaaaaagagagttgacagtacaactagttaggaaaaagcaaagtccttcatatatgatgctgtttggtgtttattcagacagaagaaattgaaattgatttcaaatttcattatatacacaaaaatacatgttatatagcttgaaggcttaagtgtaaaaaataaacagttaaaacattggaagattattttgtcaaatacacatataatccaggtcaagagatcagtttattcaagaaatattgaatctggtgatatgaagatatatttgactctatgaacttggataccttgcctatcttccttccttcttccttctttctcatctatctcagctgtctatctcctagaaccagtaaccaaatgtttatacatggtattaattttcacgtattaatattttattaatagaatcaatagcattgatagaattttctattttgttatgttctgttctcttatatactacttgatttcattaacaagagataatattaacaccaaaaattgattttgtgatccaaagtatggcttgaaaatctgctgtagagactttgaatgtttgcatctctttagtgtcataaatatatgtatgcttcctgacttcttccttcctgattttcttcttgaataagtaatttcataaaccattacaacgcttagtatgataaccgtttgctcctattgcgggtatgggctgtggtctggtagagagaatcagaaccccagagggggaggaacatgcagtagtatttgtggcagcaacgtgcacagcaggaagtattagagccttagtcaaatgagaaaggcatctgagagggtgggaggcaaatgtggccatgtttggaagatgaaatgttttggggagccaaatggactggcagtgaagggccagcaagaattgttaagagtctaatgagggtgagtagggcatgcccatgaagtgggggacagcagcagtgtaatttggggtgtcctagactgagtgatatcaggctatctgggctgggtggggtgttgtggaagtgatcaatgtaaagaatcagagcctgggtggggtttcagaaagtaaacggtgtcaaaaccttggaaaagggttgccacagcagcctggcatggggtcatcaaacccaagagaggaaaaggaggtcattcaagatgtctggaatgggaggtcagaacccaaagcaggtaagcagaatgtttaggactgggtcagaatgggaatgatgatttggtgtgatttcaaagcccaaagatggttacaagggcatttgtgtagactctcatatgtgttgagttagggaataatgagggtaatcatggtgtctgcatgggaagggtgtcagtaggacagcagtctacagtgggatgtcaaagcaagagtggagagagtggagcaagatggtcccccagtaatcatcccctgaaacaaacaactttcataacaagaaaatgtcaggtgagcactcacagtacctggctgtaaatacatatcactgaaagagtcactgatgaggataggaaagaaagtcttgaattgctgatgccacccctcccccatcccctggcagaagacacatggcaagaagagaggatctgtgcacttgagagagggagagtgcagcaattgtgaggctttgcattgaactcagcactgttctgtcacagcagaaagcaaaaccagaatgaattcagctgatgccggctcacagaaggagtatataaaccaatcctatccagaggagaataacccaaaccagcagttgaaacttaagttccagccagccttcccaccacaggctaaagggctctggggttctaggtaaacttgaaatgcagtctaggccacaaagactgcaactcctatgcaagtactagtgctgagctgggcttagacccactggactaggatggcatgtgacctacggtgacaatggctggagcagctaagggagtgcttgtgcaacccctccctcaaccccaggcagcacaactcacaggtcagggggatactctttacttctgctgaggagagaagagggaattgtaaagggaacattgtcttacatcttgaataccaggtaagccacagtaggataggacactagtcagtcatgaggctcccatttcaggttctacctcatggctgacatttctagacacatcctgggcaaaaatagaaacctctgccttgaagagaagaacccagtcctggtaggacccatcaactgacgcaacaaacaaacaaacaaacaaataaacaaaaaaccttggtccctgaataaccagcagtgatacccaggtagtacactgtggtgagatttatgagacttgctggcttcagatgagactcagtccagctgtggtggctatgggagagactccttctgcttgagaaaactcttgcatgctgttcgtataaatgtaaatcagtacaactactattggcaacagtatttgaaattcctcacaaaactataaatagaagcatcatatgatccagaaatctcacttctaggtataaacacagaaggatgaaaatcaaaatatggcagagctatctgcactccgtgtttattgcagcactattcacaatggccaatatttggaagcaaaataagctcaataaatggtcctgggaaaactggatatccatacactgaagaataaaactagacacttatctcccagtatataaaagaaaatcaaaggcatcaaactctgaatctgtcatggtaaattgtgtatgcatccacaatggagcattattcagccataaaaagtgacattctgtcattttcaaaaacatgattgatctggacatcatcaaattaagggaaataagaaaattaagggaaataagccaggcacagaaagacaaactttgcatgatctcatttattcatgtgagctgaaaaataaaactattgaattcatgaagatagagagtagagggatggttcccaaaggcagggaagcgtaatgcaggtttatgggggaagtggggatagttaatgggtacaaaacatagttaaaaagaatgaataagacttagtatttgttaggacaacaaagtgactacagtaaaaagcaatttaattgtatgtgttaaataacaaaaatagtataatcagtttttttgtaacataaaggatagatgcttgaggtgatggataccccattatcctgatgtgactattatgcactgcattcctgtatcaaaatatctcaatatcaccccaaaatatatgtacccacaaaaattaaaaatgaaagaaaatttaaaaatacaagtacaagtggaatgaagaaggcaatagtttggggtatggtatttgtggcatgtagtgtgaagtgttggactttgaacttggtaataagtttgtctgcgtggttgtcggtggggtgagggctgcatctgtgctgcgccagtggcagccaggcgtgtggtgtcaaagcatgagtggagtgaggagaccatttgtatggggtcataggcaggagattggtttaacccagtgacatttacttagtacataaatacaatgaaggtaagaagcaggtttcctatcagagaatagagacaaaagtgtggaaagattaaaaaaaaaaaaaaaactagagtaaatggtatgggatcagattggaattgaagttttagtgtgaactcataggtatatatataagtaaacaaaggaaaaataagtataaacaggtctttttagcctgctatttggggcattacactgtgaatttttcatctttactcatgaagacagcttctgattccaaatcactcagcacacagtggttaaattaggacaactgtagcagcaatcaagttttgctgtgctttctaaccatttatttatcaaaatccgaatgaactacctttattttggaggagggaggtaaggaatggctcagtccacttctattgctagataattgtgtctttgtgtctgaaatttatgttttttaacctggagctttctttaaaaaaagctttgttcttatgtgtgggtgagacaagtgtatgactgggaaaatcagagacgaagatgacattttttcccttattttcttttaaaaactggttttggatttaatgaatctatggtttttaaaaaagtatttgaaaccacgagacatataattgaatttttcagttttcttaataactcttccaatgtaaatattctttacttttcaatttaaaatacattgttttcttagctccaaatcaactaattcttggtagttaagtatagaaacaccatagggactttgcaggatcagttgagtctcccattgttctcactagacaactgatacttattagcagtttattgagtatacttcactaacatggtttttgttcctttctatttatcaaaatctcagaaaaattacagcctttatatacttacactttaatcaacaatagctgacagcatgtgaagcaataaatagcttcaagacatgcaataaactctgaggtttatttacaaaacaacacagtgagaatcatttattgccaagttactaaaggtaatagtgattactgctattaaaataccagaagctattaaatagttgcccaagcaaatagtctacattcaaacccagaattcaaattagtcttttttcatttaactttagaaaaacagaatagtttaactctgttcaattagaaaggaaaaaaaaaataaccaagaaacaacaaaaattctccaattcaaacaggtttagaaattgtaagcttttctttgggtcatacaatgggcttttggcctgaagcaaatggaagttttcactttctactatagtcataaacttttgctgataggtcatttataagaaggaatgaataaaagtaggtctctaccatttccataaagatagactaacagagaacatgcagtatcagttgattatcacttaggaaactggaaagagtgtttcttggctttaaaagagacatgatagaaatctaaaagcacagcagataatagggaataaaggtctatttgaagtgtctcttccccagaactccaaaatacacctttattatgacatataattccctagtgattgcctataaaattctattaaagataaagatcttggccaggcgtggtggctcacgcctgtagtcccagcagtttgggaggccaaggcaggtagatcacttgaggtcaggagttcaagaccatcctgcccaacatagtgaaaccccatctctaccaaaaatacaaaaaaaaaaaaaaacaaaacttagcttagcgtggtggtgggcgcctgtaatcccagctactcgggaggctgaagcaggagaatcacttgaacccaggaggtggaggttgcagtgagtcgagatcatggctactgcactccactgagtgacagagtgagactctgtctcaaaataaataaataaataaataaaataaagatcttctattctacctcattcctctggcgaccatattcctctaagtcggggttcctcagtttggtaccaatgacatttttgaactggaaaattctttgttggagaggggatttcctgtgcatttagggtgttcagtagcatctctgacctctatcccttagttgtcagtatgatctagtccccagtcatgataaacaaaaatgtctgcagatattgccagttgtctccaggtggggggtgggggcaaaattgtatctgacagagatccattgcttttatcaatctcaaaatgcattatctgtcatagagtccaattaaaacaacacatagtttttgaaattgagactatctcataaaagctgagacatatgcttcctgaagtcagagttattgtaaccaaccacttgttactcatctcaaaacacattcactgatttctacagtcctcccctgctctgaggatttggttttcaggcaggtggagacataaatactatttaatttctaatgcatcatttcccatgtctctcaaaatgttcccaatagaggtcacacatttttacatataagaaaaaaattcagagtgaaaatccacacaattttaaataataatatatttaaagctaatctaaactcacaataatcttggggatatgaaacctggggtaacagttcattacagttcaagaagtctcatggatgtttgaaacttcaaaggagagcactattgctgattagttacgtagactgaagttttcagtctcttgagaaaagtttggtatttcaaatctgaaaatgatttaagcttactggggaatgaaataaactgcaaaacctttctagcactctaaatcctgatatcacagagattacatctgatattagcatattttgtggtgcctaaagcagttttaggagctgacaattgccagggaaaaagagaatttccgggaagtttggtcctaggaactggacatgtgtaggcatttctccaaattcaaattcaaatatgtataacaataacaataggcatttgtataatagtgtacatataaaacaaatttatagttgaggggatatattttattatatttgtagtacagaggcagatactatattaccgaagatgttttgtttactccagataaacaataactaattcagcacgtttaagcattcatcttgactctcctcactttccaactctacatcattctctgaggcagcaaaacatgtacactcagtggcctcactacagcagtctctccatcttagaacagtgtgaatgtgctctgggcaatatctgtagtgtgaagaaatgtggcttgagtttgttaatttgtaccgtgtcctcatatgcacactttctcaaagggagagtcccagagtccccataacagtcttttaaataaatcttgttctttatactgtgttctgcacttctctaccggtccttctcccaacacagacacacacacacacacacacgcacatcttaatttagaaagaatagcaatcattatttgtaaagacaactgttgggacagcaacaattctctggagaaaagtctaaaacatatcttcttaaaatgtattcctttactattaattatatttgtattagtttttttcacactgctattaaagaccccaaactgtgtaatttataaagaaaaaaaggcctccacatggctatggaggcctcacaatcatggtggaaggcagaggaggagaaaggcatgtcttacacagtggcaggcaagagagagagcatgtgcaggggaatttccctttataaaaccatcagatcttgtgagatttattcactatcatgagaatggcataggaaaatctcgcccacatgattccattacctgccacctggtccctcccacaacacgtggggattattacaattcaaggtgagatttgggtggggacacaaaaccaaaccatatcaatattctgtctgctttttaaatatttttttattttttgaatttctatagtgtatttattatacttcatcacttgggtttctttttattttagaaaaccctgaatccgccatttcctagatgtcatctcaaggctacataacactaagtcctcattacagagttagtaaaaaacaagatggttatcataactgtcttcattacagaggctgcttgaaaatgaagtctacacagagctaaccaataagaagacagtagaaagcaacacaccaaggcaccatttgaaacctcagttgcagcctttcttaaaatcagatccacatgatagtcaacaattttttattgattacatagtatattccaggcactgttgtagttactagggatataatagcaaataaaacaaactctcggtgattatggacctaatataatacttggcatgacaatataacacaaaataagcacaagtgcatataggattacagcaaagaggataaagttaacagaaagcacagcatgttggaatattattattttttataaggtgggtaggtaagaccacttcactccaaggaaatgtaagcaaagtctgcaggaagggaaaaactaagtcatgagaatatctgaacaaggagcctttcaggtagtggaaatagcaagtgaacggttccagaggtaggaatcactcagtgttccaggaggtcagtaaggctagagtggaatcagtgaaaggatgagaagtaggagatgaggtcaggtagctatcagtacaacatttgtttttatcttaggtaatctgagaagccatgtcaggaatttaacaaaaatgtgaagtcattttaggtaatttttttaaaaagtattattctgttgcctgcaactgaccacaaaagggcagggcggtgggctggagcagtccagtagggaagctattgcaataatctaagtaggaggtaggtgatggtggctaggattagggtgaaagcagtgggaatggtgagaaattgtagaatcatgtaaatatctttggaccaaccaaatttattgattcattggtgacaagggggcctgtggataaagagaaaggtcagggttcacttaaagggttttggcccaagaatttggaaggataaagttgccatttactgggtagggaaaatgcagaaggaccacctgttttcattaagataatggaaagtaagtgtcaagcattgagcatgggaaatactaattttgagatgctctgataaaaaacaccatgatatgcttcacacatcctccttcaaggaatgacgggattattcccttatacattagaaatgttgcacactgaaaggcttcagctatcagtcctattcagagaatgcctcatctgaggaaagcccaaggtcaagcagctttctgaggcaacctgcgtctaatgaatattgatgcagacatataaacagcctatctccttgtcacagccttacaaccctgaaggaccatatcacatccataattttccctgtaggcagctgaaagctttacttggactgcactgaagtttaacttctccatacatacaatactgctttcttcccctcccttcaataggagttgataccccaaacactccctaataaagatcctgtaattgaatcttaatttcaaagtctgcttcccagaaaacccaacctacaaaagatgtttctttagtaaccaaagggaaatactgttgttacagattgacatggatctatagttttgagacagagagctaaactagacatttgaattagaagttatgagcatataccacttaaactcattagatctgttgaaataatctttggagtgaatggaaataggaaaagaagaggttaaagttgaaagaagggtgtttcaatttttaaaagtcagggaagttaaggggaagaagtatcaaagaaaacaaaaatagagcagcctgggagtatggaaaaagtcccaggagattggggtacactgtaggtcaactaattaaatttttaaataaagaagaaactatcaattctgtcacatcatgaggatgggttgagtaagatgagaaattaagttgtcaatggaatgggcactgaaaatgcaaaaaaaaaaaaaaaaagccatttgagtggattaatgtgactgaaatcctggttacaatggagtcaacagataatcctggaaaggagaataaccacaactttcttcaggccagtataaacaatatatttgagaagtttccacagtgaagggaagcacagaaatggataaattgctagaaggtttacgggaccaagagaaattttgttgttgttgctttgtgttcaattgcaagatataatggcagtattgcatgctgatggaaatgatcaggtagagcaatggatgcttatgatgtaagaagcacatagggaaattatgaagcaacatccttcagagtagacatacatggaatcagtagaattcaatcagatcagagtcagagtaaagagcccacaattagaaggtgtgtgttttagatttgcattgggccttgccaattacatttccagtcctaagtgctagtgaggtccaataaccagtgtcattctgcaaagtgattatggatcatgatgagacattaaatactgagttgtgtttagaaaattttaaagtgatttgacagtaattttatatatgttgaatctaacagttaaaatggctttcattttacatcttttgtatttcatttttctagtaattcatttaaatgcaccctttataacagaaactttaagaagcactgatctagcatgcaagtgaaagaaatggtttatacagaaatgaggagtgcttatttttaattactgaagtacaagtatcacaggagctttggtgttgcttcgccagctggaaacttctgcggccaatggcaccttctacctgaggattgcctgtgactgctgggcttgttccacctatgcagcctgacaagctgtgctcggtttgtgctactggcccagatcccacatctgccaagtgtgagccaaaagcagagtggcaaaggggtgtgaaggtgagtgaatgtggggtccagtcactgagcacagccaggcacactggctgctacaagagggcaggcagctccaggtgccagtataggaggaaggtccatgtaagcctgtggttggaccagatgcaggcacctgcatctggatgaggggaatatggtggcttgtggaagcttggagatgccaggaactgcagaaccccaaggagggtgtcacagccctggtttggggagcccttagatctgggttccataaagggccacagctcttctctccttcctgttgtctgcattgtggtgtcggggatggggtgcctgtttccgtcctgtttgtgttacagctcttcttttagtcctgcccaaccagcaggtcctgagtttttttcctacatctaggaagaatgaggtacatagacaaatggagggtgagcaaggcagagaggagtttcactgagtggcagaacagttctcaggagacccaaagtgtgtagctcctttcctcaggcaggtagtcccaggtccagcttgtcagtggagaggagatccacagtgggtggctcccttctgcaggaaggtcatctcattgtctgtgaagccctcgtggagaggagacccagggtgggtagctcctatctgcaggcaagttgttatgtcatttgctggagtctggctgagtctgggggttttaatgggcctcataggggaggaagtacatgctgattggtccatgggcagccaggggcaggcccaaaagcagcaccctaaattctcattctgatctgccgaactgacagctgggcccccaggctattactataaagctaccaatgtcattattcatagaactagaaaatactattccaaacttaagtggcagtgaaaaagagcccaaatagtcaaagcaatcttaagccaaagaacaaagctgaagccatcacactacctgcattcaaattatactacaagtctacagtaaccaaaacaacatgctactggtagaaaaacaaacccatatactaatggaatatattggagaacacataaataaagccacacatctgcagccatctgatcattgacaaagtacacaaaaataggcaatgaggaaaaactccctattaaatcagctggctagccatacatagaagaatgaaactggattcctagttttcatcatataaaaaaaagtaacccggctgggtgtggtggctcacgcctgtaatcccagcactttgagaggccaaggagggcggatcacgaggtcaggagatggagaccgtcctggctaacacagtgaaaccccgtctctactaaaaatacaaaaaattagccaggcgtggtggcaggtgcctgtagttccagctacttgggaggctgagtcaggagaatggcatgaacccaggaggcagaactggcagtgagtcgagattgtgccactgcactctagcctgggcaacagagtgagactctgtgtcaaaaataaataaataaataaatattaaaaaaaataaattaacccaagatacattaaatacttaaactaaaaactaaaactataattcctagaagaaaacctaggaaagttttatttttatttttttttgtcaaaatgatgaattagagactttggtgcgcctcagccacttgaaaatagcaaaataaatcataaaaatgaactctgtgaactttaagaagaaaaacgggaatccaatggaattatgaagaataccccagatcctggagaggaaaacaccagcaaacagctcccacgatggtgtccagttgataaaaagaaagaaagaacaaagaaaatatcccacctgcatgaaaaagttacagaaattaaaaatcctagtgtctccagataagaaaacatcagtgcaagaattctggcatcatgaaaatctgaatgtagtgataccaccaaaggattccactagattttaagcaatggtccctaaccaaaatggaaactcagaaatgacagataaataatataaaacatggattgcaaaaaaattcaataagatccaaaacaaacttgaaaattaacacacaaaaaaattctaaagcaattcaggaattaaagaaaaagataaacgtcttaaaaagtaatcaattacagcttctggaatcaaaaaaactcttgaaaaatgttaaaatatatcaaaagctttattaatagactggatctatcagataaaagaatttaagagcttgaagataagccttctgaagtaacccagtcagacaaaaataaagaaaaaagaattttttaaaatgtacaatgtcttcaagaaataaaggattatgtaaaacaatcaaacctattaattattggcatttctgagagagaaagagaaaaagaaaacaacctggaaattacatttgagggaaaaattcaagaaaatttccctgatcttgccagaaaggtagacatccagaaacaagaaatcaagagaacatctgtgagatactatataaaatgacttcactagggcatacagccacgtgactgtccaacatcaatacttaagaaaatttttttttttagcagtaagctcaaaatagcgaatttcattgtttttttaaattattattattatactttaagttctgggatacatgtgcagaacatgcaggtttgttacataggtatacatgtgccatggtggtttgctgcactcatccacccgcgatctacattaggtatatctcctaatgttatccctcccctagctccccactccctgacaggccctggtgtgtgatgttcccctccctgtgtccatgtgttatcattgttcaactcctacttaaaggcagatagagaaaaaggaaagatcacctacaaaggtaaccccatcaggctgaagcagacttctgatcagaagacttacaagccaggggagcctggggatctattttcagcatgcttaaagaaagcaaattccaaccaagaatttcatattccatcaaattaagcatcttaagcaaatgagaagtaaaatattttcctgacaagcacgtactaagaatatttgttaccactagaaagccttcaaagaaatcctaaagtagttctaaacatgggaaccaagaaccatatctgctaccacaaaaacatacttaagtacatagcccacagaccctataaagcaacaacaaaatagaaactacaaagttaccagctaacaacttaatgatagaatcaaaatttcacatatcaatattaacctggtacataaatggcctaaatgccacccttaaaaggcacagagtggcaagttggattaaaaacaaaacaaaaccaagatccatatggctgctgtctccaagagacccaccttatatgtaatgatacatgaagtaaagtaatgatgctcaaagtaaagagatggagtaagatctactatgcaaacagaaaaggaaaagaacagggattactattctcatatcagataaaacagagattaaactaacaacactaaaaacaaaaaagaagaaagaaagaaaggaactacataatgataaagggttcaattcaaaaagaagatttaactatctagaacataaacacaccccacattgtagagtctagattcacaaaaccagtactctagacctatacaaagacttagccacacaataacagtgagggagatcaagaccccactgacagcattaaacagattgtcaaggcagaaaactaacaaagaaattctggacttaaactcaacacttgagcaactggatccaatatgcatctacagaatactccacccatgcaccacagaatatacattcttctcaactgcacagggaatatactccaagatttaccacacgctgagtcataaagcaagtctcagcaaatgaaaaaaaaaaaagaaatcacagcacccatattcttggaccccagtggaatgaaaatagaaagcaataccaataatatttctcaaaaccccatgattacatggaaattaaacagcttgctcctgagtgacttttaagtaaacaacaatatcaagccagaaacataaaaaattatttgaaataaatcaaaacagaaacacaacataaaaaatctctgggatgttgcaaaatcagtgttaagaagaacatttatagtgataaatgcctacctcaaaaagttagaaagatctcaaattaatgatctaacattatactagaggaagtagataaacaagaacaaactaatcccaaagctagaaggaaaataagacaactctaattagagttgaaccaaatgaaattgagacccaaaattccacacaaaggataaatgaaaccatagtttcatagttggttctttgacaggataaacaagatcaatagactgttagttagattaataaagagaagaaaagaaaaattcaagtaggcacaatcagaaatgacaaaagtggtgtaatgtcacagccgatcacacagaaatacaaaactccctcatagacaactatgaacatttctatgcacacatactagaaaatctagaggaaatggaaaaattcctggaaacacacaacctctcaagattgaatcgggaagaaattgaaacactgatgaaaccaatattgagttcaaaaagtgaatcagtaataagaaacctaacaaccaaaaaacagtaataataagccccagtccagatagattaacagctgagttctaccagaggtccaaagaagagctgatagtaattctattaaaactattccaaaaaatcaaggaggggtgattcctaactgattctatgaagccagcatcacctaatatctaaaccgggcaaagacacatacacacacacacacacacacacacacacacagagacagacacacacacacacacaatgaaactactggcccatgcctctgaagaacacagacacaaaaattctcaacaaaatacttacacgtcaaattcaacaacacatcaaatatttaatttacgatgatcaggtagggttaattcctgagattcaaggttgtttcatcatatttcaacatatacaaatcagtaaatgtgatccgatcacatgaacacaatttaaactaaaaccatatgatcacctcgagagacgcggaaaaagctttcaacataattcaacatcccttcatggtaaaatccctcaagaaactaggcatcagaggtacatatctcaaaataataaaagctatctacaacaaacccatagccagcatcatattgaatgatcagaactgcaagcattcctcttggaagtggatcaagacagagagatcttgtctcaccactcctattcaggacaacactggaagtgctagccagatgttaaactttttttttcatatatttgctggaggcaagaggaagaaacaaaagcatccaaatagcaaaaaaaaaagaaaaaaaaatcagactatctgccttcactggtgatatgattttatacctagaaaaccctaaagactctctcaataagttattagaactgatcaacaattttagcaaggtactaggatacaatcaatgaacaaaaatctgtaggagttctatacaccaataactaagagccaaatcaagaacacaattcaatttacaacagccacaaaagaagtaaaatacctaggcataaatctaaccaaggaggtaaaagatctctgcaggaagaactacaaaacactgctaaaaaaaaaaaaaagggaacccttgacaaaaataagcactgtggaaaggactccctattcaataaatggagcttggatagctggtgagctatatgcagaagaatgaaactggatacctaccttttactacatacaaaaattaactcaagatggcttaaatattttaatgtaagaactaaaactataagaatcctagaagaaaacctaggaaacactattctggacatcacctttggcaaaggatttatgattaagtcctcgaaagcaattgcaacaaaaatgatcattgataagttggacctaattaaactaaagagcttctgcacagcaaaagaaaccatcgacagagtgaacagataacctacagaacaggagagaatattcccaaaatacgcatccaacaaatgtcttatattcacaatctacaagtagcttaaagaattaaacaagcaaaaacaaaaaattccatcaaaaaatgagtaaaagacattaataggcacttctcaacagaaagggatacaagtagccaagaaatatatgaaaaaaatgcttaatatcactaatcatcagagaaatgcaagtcaaaaccactatgagatacctactcacaccagtcagggtggctattatttaaaagtaaaacaacaacagatgatgggaggctgcagagaaaatagaatacttatatactcttggtgggaatgtagattagttcagccacagtggaaatcagtttggagatttctcaaagaactaaaaatagaactaccatctgacccagcaatgccacccaaaagaaaataaattgactgaaaagacacaggcacttgtatgctcacagcagtactcttcatgatagcaaggacatggaatcaacctaggtgcccatcggtggtggagcatataaagaaaatgtggcacatatacactacggaatactacatagccctaaaaaaggaaattgtgtccttcttagcaacctggatacagctggaggccatcatcctaattgaattaacacagaaatagaacaacaaatattacatattctcacttataagtgagaactaaatggtgcatacatgtagacataaacttgggaacaaaagacactggggagtactagagggggctggctgagagggagcgtagcaaggctggaaaaaccaactgttgggtgctgtgctaactaccttggtgacaggattaattgtaccccaaacatcagcatcatgtgacatacccatataataaacgtgtacatgtaccctttgaatctaaataaaaacggaaaaataaagaatggcaaaattaaaagaaaaacaaacaatacattttgctaaatgaaataagtcagacacaaaaggacacatgctatatgattccacttatataaggtagctataacagtcaaattaatagagacagaaagttacatggtgggtgccaggagctgtgggctggtgtttggggagttagtgtttactgagtacggagtttcagtttgggaggatgagaaagttctggaaacagacggtgatgatgttgcacaaaaatgtgaatgtacttaatgccaaagatggttataatggtaagtatcgtgttccatatttttattacaactacaataataaaagatatgtaggaatttgccagatgaacaagatgaaaaagggcattgccatgaaataaacataatgaatctgaaaaaaataaaagcatctttgattgcaaaagagcaaattgcaaatatccaaagtaatccttgtaatacacgtgacattataaattttacgatgcagtgcctatgattcacgcacactgtacctgaaccagctgtgaaacattcatgaatcataaactcctgtatcatcttcagagcaaaaatgcatcctattttacaagaaatattcatcaaaaaagggaaagagaagtaaaaaccctgaaatttctagaacctttcaaagatatcagaaaaacaaatcaatacctctgacaggacctgttaattcagagggtcatgctgtaagacagcttgcatttaattcaaactgttttggaacaagatcaattctgtagtgagatcaaggcagcagaaatttttcctcagggctaaaaataataattccttgaggcccagacattaaattccatggcttcttgaaactattcaaaaatgagaagaatggataaagattaaaagaaaacacatgctgcaagctgacaaaacacctttttagacttacacccaattcgttcattagtcaaatgtgtggttttttttttcccttcaggtaactggaggtgtcaacattcaacttcttggtctgtttctcgtcattttctattttctcctgctatttgtctctgagctgttatacctgttattgcagtttccaacaagaaaaagccaggaaaaggaaagagaatcaaagcatcagagcgagtcacctcactgggaggtggaaccagaagttttaaagcagtagcaaaatttgtatgttctgggtgtcagtggacactttctgtataataattttattttacttttgttaagaatcatgaagcaaccacaaaaaattaaatcaaggcttatcaagtagatgtttgaaagagaaacaatgattcaccttataggtagatgtactttgctattgaagggattgtgggcaagtctaagcaaagctgaagggaataaggaaatttcattccttagagaagacagcatagaataatagtacagagagtgtagggtagaacagcttgcattctaatcccacatctgcaacaggattctctttgacataggaaaagttacttctgctttgttgggagtattaaaaatggagaagttttcaagtgcttagtgtagttcctggcttatgatagcatcaattaaaattaggtattgatgctattattattaatattgatctcttagccatctatatcttcagcatccaaagtgtcagtttgttctttaaattgcaattgacccttttttctcaatagaatagctagtaaaataataaagtggaatttcttggaatgtatccattctcctcttttacatttcatttttttattcattatttcaaatgcccagtaccttcttgttcaccctaaaatcttttatgagtttatgagttaacaggaaaacagattccttttagaaaattggaataaaaagaattaccattttttttttttttttgagaccgaatctcgctctgtggcccaggctggtgtgcagtggcatgatctcagctcactgcaagctccgcctcccaggtgcaactgattctcctgcctttgcctcccaagtatctgggattacaagcatgcaccaacacacccaggtaatttttgtatttttagtagagacagggattcaccatattggccagatgggtctgaaactcctgacctaaggtaatccaacccctcagcctctcaaacacttttttctacatttcaaactctttgcaatttacctgctatctcatttaatctcctcttccctacactgaagacaatcaacctccctcctattaaccaaccacttatcctgcctccttatgtaccttaaatacgaaagataagatagtccccattattttaataaatatttattgaatatattcttgacaagtaatcctgcttgtatttttagctagctaatgtgagatacatctttgacatggttaaatgtatgatcccttaattaatttaatataataaactaatgctacattataggggtataaacacttttaaaaatatattttctattttaaagttggctttatacttaacataaatataatggacactttgtttatttttgaatgattatcaatcattcaaaggtcagtacatctgacctttcacaaaaaaagtaaaaggtcaaatgtaaaaattgtaggttttgtggttcacatatagactctgcatattattctttaatttttgtttttggttccatatttttgtttgtttatatgtttcttacaaaccttttaaaatacaaaaaatattctatcttacttgtctctcaaaacataggccatttaacccaggaactgtatttggtcaatctgtgcttcactgtaaatgttctttgttattttaaaagcaatacggacatatttcaagtaaattattgttttcactaccactcattttcagatgtaagtccacaggttaacataaataagaaagtagcagccaaaaacaaaaaaaagagagaacagtaagaaaaacattttaagtcaaaggaaaattgccagcttttatcttctcctaaatcccaatccttcactcctaaaggaacacattaagtgcaaagggggtcatacttttattccattgcaaaaagggtcatacttttattccattccccatgtatacatttgttatccatttggcaaattgtggttgaatttctcttgggatgacctcgccagcagtaggtgaatggatcatttgattcaacactagttcgtaagtgattgttcttttcaatcaggcacacactcactgctgataactgcatattttgactatttgtagaagtgttaaaggaactaagaattttatcgtaaataagccatgttggaacaaatatcaaggccttgagaataatatactttatacctttgctcaacatataatgtaggaaaatatccaattaagagtctagaaatggagtgaggaagggccagctgagtattttgtttaatttttaattgttaactcttatagtaccttcataaagtttccaaatcttttcctttttcttgcttttgctgtaaatacaaaagtccaagcctgcattatattatactcagtttgaataaggaatatcagctccttaagaataaaatgaaacagttttattcttcccaagatcttttcaggcttttatattgatcatcttcatttctgctgtgtagctggcttcatcaatgatgtctcaatttatgtctataattgttattttgcaaaactgtctcattttaattaatatgatgccttactcattatttttaaattattttcttcattattttaaaactaattttatttctaaggactgggaacagggtgggtggatgtgataatctcacacatgttcttgtcttttttccttttattttccctctggtgctgggatagagaggatgaagaaagaaaaatgtattcgttagatgaattatctgtattgaggttgttctaggattactgtgctagaggaaggacccccaataaattccaccattaagaggctcaatatcaagcaacaatcctgtgatctagtggcactgtatggaattctaacgtatcttttagctaatgtccaggtggtagtctgtgttacatcttgatatgcatacctctcttcttcacatgcttcagtatcctttattttatttataattagaagcacaaactctgagatttacggatccaggcaggactgatctcacctacaatactgggcaagatcttcaaggggacagttgatgctttcttgccaactgcccactccaccaccacatttctctccaatgttctctcccttgttttagttgtactgactcaaatctaagcagctatttgattagagtattgaatggtgatcttccctgttttgtgtgaatttctttgggattttcttctctcaatccttgccagactttttttgtaataacactggactagcaacaatttcaacctcacctatttataaaataatgttatctagtactatttgagacctctcttacttggattttttggagtattgtactcagaatcaggaactttttgagataaaatctgagaaatgaataacttttgctcaattgtgctttattcaggttcttatctgtattctattctataatctccaagtgaggaaaatagtcaattcatatttctctaaagtgtttcttcataagagccttaaaataaattgtatatattttaaacattagtacatttaccccaatataacatcacaaaattaacctttggaaaatacagaactaatgtaatacaaaacattcccatccctccaaaaacagataaaataaaatataatagttctctacagcctaatctaaaagaatgtgatgtaatggatagagcactgatttattaatcaaagggagaaaaactaatgtggctcataaacctttccatttctgagtctcattcttttcattttcccgataataatgataataagatcgacctgtttgttagggtcaggttaatgaccaagtgaaatgatgcgttatacatatgtcaaagaaatatagcctcttaaaagaaagttaacgcagctgacattcagtaacatatctcggtttgtaagtaaaaaattagaaataaactcaaataaacgatcaatacatattatagtaaaaagtaataatttgaattaagataacttgttgaacactgatttatcaaactctattgaactaacccattttttaaatttatacttttgtttgtttgttattagaaaaacatttccctagatagaagctgctccactattctgaagggaagtagaaacgatgaaaagcagaactggagatgatccatgatggacatatagtgtgagtaagaaatatatattatttgttttaaatcactgagattttgagtttgtgtatgtgtccataatatgagctaactatccttaatgataccataagtaaagaatttaaagtaaataagatgtgcctgaccgcatattaagtgccacactaagtgttaattatagctccctggcggtaaacaggggactggttccagacttctgagtatataaaaaatccacacatactgaagtcccacagtgggtcttatggaaccctttgtatacaaaaggttggctctccaaataggcaggatttatattatatctctcaaaaaatctgcatataaatggatctgtgcatttcaaacttgggttgtgcaagggtcaactgtgttactattttatgggatgagacggcagagatgatacatggaaattttgtgtttaaaaaaggagaaatatgcaaatggtggtggggtgggccaaatggaatgtgagttacatgaaagggtaatttggaaggaaacaacgcttttgtgaagaaaagaaatacttgaatatttgagtataaaacatagttttatttagtacccttgcctcatctttagtatgataaaaatagataaaaaattcagacagacaaagagggaggaagctgcttgagtgaacatactctgttgatgtaaatactcgaggaaattagctctatattgggtggtgtgctgatgaatgcttaacaaaaaaactttgaagtgaaaggcactgatttgttgtatttgatgatttctgtggcataaatatgcccaccatagcaatgtttagctggtaacatgacatagctgcacagagtcaggaagagatgcacatgactggctctcacgatttcggcgcggtctggctccagcatttgactgtgacaagtttcactggccggtgagaacgctggaggaaaaaaatctacctataactgacccttattagcataacaggtttgagaaagcagagccctattttcctcaagtgaatgccatcaatacagccgtcaggcaaaactgcattcatgcactgaggaaaatcactgcttctcaaacaacttttggataccataaaaggcccgttcttaaaaggggaagtgggaggaggggaaacaagaattgttgcctgaaaagaaacgactttgatctccatcaaaacagattagtttgaagccaatttgctgctatcttcaaaactatatttcccctcaaattctgtcttccaaattgagcagtgcgtcagctgtaggtagtgctagagtgtgaaaaggatgaggatggaggcagccagggtacctccaatgcatcttgttattagaagacttttgaagagtaatttgacgggagcttttcaacttttaggtcactagtttaaatgtagtctcagttgatcatgaacaaaagtgggtggttagtggcctatgaaaagtaccttcatggtattacccttgttctttctaatagagactgccactacagttggcatcctttcttttccttctaccagaagcacaaagggtgaatagaaatgtcatttcaagtattttttcagcctttgtaccagagaaatttgaaatatgaaaaaggccaacttcttttcatctttaactcacaggtagaattattgaactataatatgtttcctagatcttcctggattttattaaaatgaaacctgagccactttacaagtaaaattatgtcttacttcatagaaagttaaattacataaaggcacatacttgacaaatatttaaatataaaatgtataatttcttgacctgaatcttacacatgtaaaatttattttgttttccttttctttctcttatttttttcttgcttcaataaatgagttcccatgaatgtaaagacaaagatcttattactccattaaatgaactatcttaatatttgattttttctattctttatcattacaatactttgacttttttttcctcctaaagagactgtaggttttattccctttcttttaattatttcatgaaaatcctccaaatttccatattactaatatctctaccttcatataattttgtttcaatattaaatgatcaattaaagcaaactttctctaagtacctggagaaaagcaacagaataaatattagagtagagacacaaagtagtacttggtaatgccaagaaaatttcagcagctatcagtaatcagtaggatataacagaaatagccctgttttagaagtgatgaaaactcaatcaactgattttaagcagcagttactttctatggggttagctttccacatctcaaaaataagattgatgtgttatttttgcatcattttcaatacaaacattctatgaaatcttcacttttatatcatccgaatttaagtgacagggtgttaatattcgaatgggatttaagcgagatgtagctgtgccttatgtcacgtcagctgatggtaaagattgatgctgggattttcctgggttagtcatgttaaaatctcccctaggctttaaggccagcttcatgaattctcatatcagcaacttctgcaattaccacataacaccagaagataaactctgttctctgaacattcatatagaaaatagtacgtcatcttatgattcttatgattggcatagcaaagtgaaaatatatcaacaccgtatttagcccaacttgaagctgcatattcagtcaaagatagagcttttcctggccaaagatactttggtcagaaatatataaacagtgaacaccaagctatcatcttgcaagtaacacatatgctcatgaatctctagctacaaataaaaatatcagctaaaactacccccttcttctaaaggaataaaaaccacagcaattacaagatttgcctatggccataaaatgaagtggggtttgtctcagaattagaatgcctaccatcagcctttgagtacaaagttaattcccctacacaagactgcatcaaaaataaatccagctggacaaaaggcatacaagacagaaaataatagtcagctgcagactctttggatccaaagtataaaatattcaagtatgtgtttccaatcccttcattctctcctgtaatgattgcagctaatccctgcctgccaaacgttagttcttcaattgtggcgatcaatagaatagattagctgtggaaaccctccatccatattacccttgctttcctttccagatggaattttcattcactagagtggaggcaagcatgtgaggtttctccctccatacacaaatataaactcattaaatgccaagcttgtcactttagaatttatacacacacacacacacacacaccaaggaacatacctgtagatttaataaaacagcaccaaccctcatggcttcactaatttcaaggctatacatcagctgtgggaagcgaggagggctttgattatttggtggaagcacttcaatatacacagtgcagatggagttcctgcagagaaagagaggaaaagaagatggttacgaatctgcatcacatttaatgttagactgcattgtttattcagttgttgggtttacaggagaaaaaatttccaaattttatgaaaaataatacaatcaaaatgaaaggatagaaaaaactaccaccaaagtataatggttttatgaaattatcttagtaaaagtaattgactccagtatctgtttttcctacttagattaatagtatgaattaaaatggaatagctatacaaataaagctaataaattaacttgccttgacttctgactttgtttttaatgcttctctaatagcaaaatcattctataaacatctggtaataaaagctgtccttggggcttttttgctgttaaaccagcagagggagtattgattacaataactcacaaaacaaattatgggctgcgttttatcagttctgttgctgacatcaatggcttaatgtaagtgcatgtgaggagtcaggatcataaagaatcctacgtaaaatagttgcaaacaaaactaaatacgttttaaaatcttctctaaaaagcaatatatgataagctaggaattagatttaataaagcccttataatgacaggagcttttcttgaaggacaagataccttatcattacaaggaaaaaaaattagcattgacatagtcaacttctttgatatctctgaactttgaatttgttttataaaacaaaaactgaagaagcatgttagtcaaggtttgtaaggtggaaacattagctgaaatatatcaatgagatctgaaaatacataaggttagccctctatcgtgaaaaaacatatatatgtatacatacacacacacacacacacatatatacacatatatacacacacatatacacacacacatacatataacattttgtacaaacataccaccactgcctaagatgtatgctttgaatttaacaaagtcatgatttagttcaaaacacatttgttataatttctatttggggatgagaatctttatttatttatttatttatttatttgagacggagagttgctctccagcccaggctggagtgcagtggcatgatctttgctcattgcaacccccacctcccgggttcaagtgattctcctgcctcagcctcccaagtagctgggattacaggcctgtgtcaaaatatctggctaatttttgtattttcagtggagatgggttgtgccatgttggccaggctggtctcgaactcctgacctcaggtgatccaccctcctcaacctcccaaagtgctgggataacaggtatgagcaccacacctggcctagaatctccttaaagtagtcccaaactctttataagatgcttcaattaaaagacatggtcaccaaaaatatttgtctgagtttattaactacaacattctacttttcaaaaccttttgaaagaaattcaggctgggcacggtggctcacacctgtaatcccagcactttgggaggccgaggcaggtggatcatgcggtcaggagatcgagaccatcctggctaacatggtgaaagccggtctctactaaaaatacaaaaaattagcttggcgtggttgcgggcgcctggggtcccagctacttgggaggctgaggcaggagaatggtgtgaacccaggaggccgagcttgcagtgagccaagattgcgccactgcactccagcctgggcaacagagcaagactccgtctcaaaaaaagaaaaaaaaaaaaaagaaattcagatcataggcactaaaatttcgttttatagcttgtcactttataatatacctaaattcaagttgtttctgagcatatcatcagtagatagataccaatagaatagtaagcataaaagctacagtgacttttaaaaatttcatggttgggtgcggtggctcatgcctgtaatcttagcacttttggaggccaaggtgagcgatcacaaggtcaggagttcaagaccagcatgaccaacatggagaaaccccatctcgactaaaaaacacaaaaattagccaggcatggtggcctgtaatcccagctactcaggagtctgaggcagaagggagaattgcttgaacccgggagacggaggttgtagtgacccgagatcgtgccattgcactccagcctgggtgacagggcgagactctgtctcaaaaaaaaaaaaaaatttcatgcttacatttatcatgatattgttctaaagtaatctcactttaaattaaaatattttaaactttcatagttaaaatatctgtattcatttctgcctctgattttatctatttagtatcaaaatttgccaatacagttaatcagattatatttcttaaatgggttcaaactgatgatgaaatgttgcttatatacttataattattaatgtaaacatgaaacaatgggaagttacaaaatgtattgtatactgcaaagattcccacttccgtgttgtgagaacaaaagaatcgtcattctgaggtagacctaacatccttccaggtggtgatctgactccagaagcagccccaagatgtaaaacattttccctgatattacccttgaagatcttggcttcttttagggtctgttgttgatcaagtttttaaaacattttatgaatctccttcttttctctgatagcacattctctatgcataacaagtcctacaacgttattggtaataaaagtaggtgagtgatgttgaacacagaatttgtaaccagatattcctgagttagaattttgacgctgccctcaatgatctagagcaaattatttctttcagcttcattatttccacataataagtgggaataataataacatctaaggtcagcataaagatgaaataagtttatatatttgtatatgtaagtacatgtatacatatatatgaaacatacttttataacttattttaataaattactcaaaataaggcttaaggtttcttattccactctatgaatagtgcaaacgatcttgcattttccttagctacatcctttataatactgtagatattttaattgaatcctttcacttggctaaattcctacaaaggcttgatactccttcacccctcctgagcatggggtatgttggtgttagaatttgagcatgttgtatcataatctttagggtaggatacaagaatctacaattttcacaaatttccaaagttctacttatagaaactagactttgaagaccactgcttcagaatctcatgaaaagtacaatatgtagactcacctgttttttttaaattacctcaggagaaaaactctacaaagtcacttaacgtcttcaataaccctggatccaagagacttcctcactgtttaacatttttttttttttgacctggaacatatctgtactgcagattcgaagctttctttcaaaagctaggccctttctgcttcgatattctttagatcttcagtttactggtcaagaatactttataaaggttttacaagaatatcagtgtcttaaagcttgtgaaagtatagttaaactacacttattatactttttgtatttctttattcctttccctttcattatcttcccattgtagagggttaaagtgagacaatgctacaataaggaccttaaactcgtatgagttacttggatacttgtcacagagtcgaaaactttaaaatgctgaaacaaagaggactctagtctcagacaaaacacagagacaaattttagcccaacatgaccgtctccttgatccgtccttactcctttgcttcctctgttcctttccacaataattcaaaagctagaattgctaattgtgttcccccacccccttggtcttgaatgttagttatttggaggagatcatatattaaggtcttgtatttttcatcttcaacatcctggcatgtccctataatgtgtttaaataaccaccaggcttcttgagggttactgccttttaaaatgctatctcctttttatccctgatgtcagcacagtgtcagagttagcttttctaaaattaaatacccatagtattaacaataaaataatagtatttatgctgtaataaatagtagtatttcaacagcatcatttaagcacttaataaaatagggcagtcactatataaataacactttacgcaagcattttgtattcatattttatcgctaaatgcataaaactgagcatctatataagaaaaattttatttttgtaatatagccagtatgatgcagataaatctccatttctaaaaacgaatctcataaagctttattatatttcacctggtaataaaggtcaaagtagcacaaaagaggtaatatatttcttatatactcttgaaacctacccaatagttccataaatataaatacatatatacttttttttgataaacatagaaattgacccttctggtcttaaagcttgaaacttaacatttgttttatctgagctccttcctcaggaaacaaccttcaggcctcccaaaaaaggtatcaaagaactgaaactcaccagatcaccacatccgatgagatgccagacccgtcattcattatgattgcttcctagcccctccctagttcctgttttcttacatattgttacatttcttccctgctatgtaaacactaactgtagtcagtcagtgagttggatttgagattgtcaccaatttccttagctgcagcaccagattaaaatcttcttctttgacaattgttgttcagtgattggctttttgtatgaccagctgcagaatctaaactgaacccctggtgttcctgtgacagattttcgttacctgaccaagaacacattgcttgtgtcttggctgccttgagccaagagtcttagaaggcctcctaagcagttgctcacccaattttcactggaggtgttttggtttttttctggccccacagcagctacccccaactacattcctgattgtctagtcagaacagcatttgaaatttgacatctgcacccggataggtgagtgtcaggttctttgtgggcctggacagcatgatcccctcctctcagtttgagaattttttaaagaaatttttatttgtcagttgaacaagcccaaatgactgaaagtgggaagcatcctgtgttagtatggacactttttgggggtttcagtatgaacactcttgggggcttgtttgtaattgtgaggtgtgtgtgtgtgtgagcaagtgtgtatcttttgtgggactagacagtgggattggctcctctcaatttgagaaattcctaaggaatttttctttgtgggttggtcaagcccaaccagtagaaagaagaagcaccccgactgtttcagtttggatgctcttagggctcgtttattgtttcagcagtaggattgtgttggcgattgtgtgtgtttgatatagtcatagcaaagtagaattcagtaagctaatattttctgaaacactgtttggctccaatattctttggaatctggagtttgctattgaatgggaaagcatgacagagttccatgtatccagacttttgtgctactgctctaaccatggtcaggcctggtcagtatgtgatgttctcttgtgatgctgtttggttccagtgttctttggagtctggggaggtttagcctttaaaaagcaaattgccatgaaaactattctacccaaaattttgattcacagccttcaatggattacctactgaggtcaagaaagtgtggctatgtaaaccagtgagtttctattgctatatcatggctataattttgaggtaaaatagattggatctttatgtgtgtttatatgcgtcttaatggtttatgtatgttcatgtattacgtttttttttgtctaccaaattggtttataaataaaagaatacacataagtaagcccaaagtatttttcaagttcaaatgagttaagtcaaccacaataagcaagctggctttaacatttttgataaaataaaaataaaaatgcctttagaattgtcagcatacatttttgctgagttttatatatgtctctgctagatatgattgaggtgtcatggtttggcatagaaggttatagaactataaacccagctaacataaaatgatcttggtttgtgtaccttctttgacaaatgagactaatgtaatgttgttagttgattcttgtgagttaatggcaaaaatacccatatctttaattttaagatttagttgaggacctgacattcatcagctattaaaaaaaaaagtaatgaacaaggaaaaagctaactttaaatgatggtgtctaatatttcagttttcagaagaaatctggataaactattaaaatgaaataatcaagtacttgtaaattgaataaatgttgtaggtacactttttgtgtaatataaaatttttaaattgtttttggtgctcattgggtgtctgggtcatttccaattaagaaaaagttatggggaaacatatttctaaaaattgtggaatggttctcatctgtaaaatgctaatatctgatagtcagctcagaatttcttgcttctcagatgttcactaaagttttgttcactaaaatttaaggctactaagaattctaaagaagatgtgtttttattgagaaaacgaatctgtttgtctagttcagaagttatctaaaggctaattaaaattatgggcttgaaatggttagttatgaaacaaggcagaagaaaaccaataagtagaagaaagagatgtgtaaaaagttatagatacgaaaatatattttaggaaggtgataatgaaaaaaataacaatttttataagaaaagattttgtatggtgaatgtttgtccaaaattaaaataactggttattaaaaaaagaacagaaagaaaatctaagacaaaacaaaagtccaagcatgtcatggatggtctgtgtaagtcatatgccatttttcctgtttctctgtgtgtctatcttcatgcctgtacaaagaaaatacaaagttgaaaaagcttagataataaaatatcctttaaaacttgataaaataggaatgctttggctaattagcattgttcatagttaaagctcatatcttaatgaatgtaaaatataaattattgtaaagaaatacattagcagtttggcaattttttaaatatagttaagcccaaagctggatgtaacatggagccaaatttcatagtatatttgctattctgcatcacatacctaaagtgaatttcttagttacagaaaatgtatagtggtactgctggacttaaagacagtaaatatcaaaaaactgaatcaggaataaaatatccatcaggttaattttttttggctctgggtaacactgtaaagccaaagttaattgagtagaagataaattgagggttggactactgtttatttctgcttttttttttttcttgagacagggtcttgctctgttgccaggatggagtgcagtggagtgatctcagctcactgcaacccctgcctcccgggttcaagtgattccccttcctcagcctcagtcctcagctgggactacaggtgctgccacctcacctggctaattttttgtattttagtagagatggggcttcaccatgttggtcatgatggtctcaatctcctgacctcgtgatccactctccgttgtcaccaggctggagtacagtggcacaatcttggctcactgcaacctccacctcccaggttcaagcaattcccctgcctcagcctcagtcctcagctgggactacaggcatgtgccacaacacctggctaattttttgtattttagtagagattgagtttcaccatgttggccatgatagtctcaatctcctgaactcgtgatcccctctcctctgcctccccaactgttgggattacaggcatgagccaccatgcctgacctatttttgcttctaattttcatttatttgctatttgttctacttaaatatacaaatatatacacatacacatatttatatgtatacatatacacataggtatacatatatgtatatatatttgtatacatatatataatatataaaactattgatgctttttagtttctaatggaaagcttttatttggttctatgaatagtcattttgttttctatgtatttccaacaattcaccatttgttctgtttattgaaagttcctaaactacctttgtcaagcttcaaaacattgatgaaggacagcagccatttaaatttgattggtttttcttacctctgagtatattgatagctatgataattttaaggttcttggcaaaaatcttataaaagacttatttttatgagttctaaacacaaatagtacattatatattttgtaatttggaaaagtagatgagaatagaagtgtttaaatgatgtttatttccaatgtaattcaattcaatcaataatttcagttggttcagatcctttcctttagtgaagaaaaactgtgatatgggttaaaagttttaatgttcaggaaagactgggctgtttttttaagaaaaattttattgattgggatttctctgaaactactttcattgtgtttaccactattaacattaagtgacactcaattgaattaggtagtaattgctttaaaaattgtgacactttgttgtaatttttgatccaaatccatttatctctgatgggcattcatgtggtacttgaaaacaaaatatgcacaagtgttgcactggtttgaagagtttggtgtgaaagttacttaatcagttgtaagtactgtatctagaagtaaatcttagaaatgtgtgatgatgctcttttaagtagctgaagagagattattatgtggttttcactttgtccttgctttgttgtatagtatttaagtgaaatgagattgcttatccttattctgaatttccaaagctgatatttgcatttgccatttttcaataatggaaaaaaaaacaacattagttgtcttgctttcaaaagtttgtcaaaggacctatcaaaactttgatgcttttggtcacagttctgtcactaaaatgctagcaattagacatatggaatgagtaacctaactactttaacaccgtggtcagaagtgctataagtagtatctgctaagctccaagccactgtgttttaatttgtgacattttagaataataggctttctgtagtataaatatcctattaactaatccttgtgctgttaagttacaggtctttgaatcctcagtctgaagaaagcactgacttctgttaaattttgagcattgataccagtcaaagcctcatcttcagacacaggagaaggtgacaatcaaaatgaactgctttcatgagacacagggccagaaattaaaactattcaatccctctagacccaggaactattgtggaaactgtaggtgtgtgagatggtgagggacaattttgagggacaaactcagttcagagtttctgtaaattaaacgttaatgtcaaaagcacaatgatgcaaggtcagtgtctgggcctatgtgtcagaataacagggttttcttggtgcattgatctgctctttaatagataatcgtaaaaggctataagaactttgtcaaactgattaaaattagatagatttgtttataaggttttattaaaattagatttaacattaataatataccatacaaagatacaattttgttttctcttttgaacaaaaatttcatgtaagaggaaactgcagggaaaaaaaggagaggggagagacagaataagttggcctcatgctatcttaagtattaggtcttattgcttaagaaacagagtctcctctctatcaaaaggtaaatgtttttgttttattattttggctaaataaatgaatattttatagtgacctgtgatcctattttgtgatatcgagtgtcttaaacctttgatactcgacagaatttccaacagcaaaatttcaagttctaaattcagtctttgtgaactcaaaccaacctttttggatattagttgccctgaagttcaagagagacatgtaaggcttattaggcttagttgttatgttagaattatgcaggagatattgtcaaatctgaggtggtgctaagtttcctttgggtgatatttatatggatgggttgttaaaatgtgtttgaggattatatgagattcctgtaattctgatatgtcttaatataagttgtcagtaataattatgattattatgttacattgttgtatgccacagaaataaccaaatttctttatctactgtgcctttaactatgactctcttaagacttttgtcatctacaattattgttttgctttgatccttctcaaaaagtgacttataatcagctacagtctagggattgcttctttggtgttcgtgaaaagaacttttcaatgcaggttactgataactttggagattgtgccattaggttagagaggaaaattccagggcactaattgaaaggctgatgtgttcataaagattgttaacccaacatgaagcagagcaataattgattgcatggactaaactaatgaaggactgaaataatttttgtggcttttatctttggaatattgctgatttttttgttttgtttttcagagtctggataattttttagatctacttataagctttaagttatgctttaagtatattaagtagagtatacttttgtaaacagaacttgaggcatattttttctctgcctattttctccggaattatattcttaattcatgtgtgttagtttgcatacatttaatgacaacttgttttcttgtataatgggacacaattggaggaagtggttattttcttagggctttgaactgaaatgggcttgggaaaggttccagaaaagccagtgtaggtcctatataaacaatgaaccttgttgcactttgggtggttaatcaggctaagtatatgggcctgaagcttcttttgcaagtagatttgtcctgctatgacttgcctttgttggaagttggggggctgaagagaaaatgctgtgtttcagaagaaaatgatactattagattagcctttgatttctgggtggccgtgaaatcacctgtagtatgacgctgcccacgatgcccctcctcagtattaagcagccagaaagactgacaaccagtttccccatgattgaaaattgataaatagaaaggggggactgaaaccgaccaaacagtcccatagatcactttttcgataaacatagaaattgacccttctggtcttaaagcttgaaacttttgtgaattgttttctgttttatgtgagttccttcctcagaaaaccacttgcagcctctcaaaaaagtattaaagaaatgaaacgcaccagatcaccatattcagataatgagatgctagacccctcattcatcatgattgctttcttgcccctccctagttcttgtttttttacacattgttacatttttttccctgctatatattcccataattttagttggtcgggaggatggacttgagactgatctcccatcgcctcagcggcagcacccaattaaagccttcttccttgcctataattgctgtgtcagtgattggctttctgcatggttagcagcaggacctagaccgaaaccttggtgttttcgtaataatcttataattgaaaaagatccttaaaacaatgtaatttaagtctcattttacaaaagaggattttaaaaatggaaaagatttgctgactgaatcaagattataacattaattagcaacagcagataaactaaaatacaaggcttctgaattcaaaatctgctttccatttctccctacgtcctacaagaacaaatatgtaaaataaactggagaatttttacttatctatgtgtgaatataaaacatttttggtttgtaataaaggatgttaccttacaggaagccataaattatttcaagtctgaggttcagactatgaagtcacaattttaaattattaatactgtgaatcaaacttcatctataacacttattgtaagaataacataaaatatgaataaagaagagggttggaaaatagacttaagatactttaagtttgggaatgatataattataaaaagacaactttttcatatgacaatagtaattagtagtaatgagataatgttgctagcttatagaggattgtattatcttattattattttctattatatatgtcaatatgtgctacaaggagtctatttgtaattctgcatttctagcttatttctaagatgaaggttacagatatttatattgctttttctggtagatttcagacagattaattactgtttttgttttcctttgtcttctaccaatattgtgctagaaaagctatgtttacagtttgatgttcacagattgtattctattatttttgaaatacatatagaaatctacaagagcaaaaacttcacattgaaaaccaatataggaggacagagaaaacttttctggagaagttacagggcagagttttaagatagaagatgtatttatatataaataccacagaacattaatagacagaggaaaactcacatgtcaatttacagaagattaaagaaaagaaatgtatgttttgtggaactaaagagaagggtgtaagtaaagcagtagtaagagttaaggtacagaggtgggactcatgggctatatctgttgatataaacttcatcttgacaatgaggctcagctggtaaagtttaagcagattagtgattataaccaaaagtgccaagtcattcacagttctttaacacactactttgttttgtttcttttgatcttcttgtttcctctgctgggatattccattatcattcttgcccaggtaaaactgcacttgtatttatctactgctatctgtctagatttacctgtgcctgcatctgaatcccatgtgggcagagatctcattttacttgttttatatttctagtacctccccaagagactaatatttgtgggaacttagacaatttttataaaaataaatgaataaataaatagcctcatcattttttactaatgataaacttagcatgtacatttgtcactagtaaaatgatcttttaaagagaaaattgtattttaaaaagaatgtataatcacaatgggaaaataattgtatttcaaagtaaattatttcatctcatattaattaaacatagccttgcattttatgaaaagaatgggaatttaaaacgtatgttagcccatgcatcagtcatttttatcgtaattttattagaagctatttggggagagagagtgtctcttattatctaattatcaaacagtagtgctttattcatgttaggatgaagtaaatatttacttaatttaattggataacgtaagtataagttaaccaatatacacgactaaagaatatcccaaaataacttaagtgttttttaaaagcttttggtttttatttcttctgtatgcttatcaaagtctcaaaaaaaagtaaaacaaaacactaaactatgtactattccttctctcactctctgaatctttagctggtttactaaattagaataacacagacatacgtatttcattcatattggacttattttcagtcaatattactacatttatggatgaaagctgtcaattttaaaataataatatagaaaactgtctaaattctgaagcctgctgtcattttttgatgttattatttagttagcttacatgccatggttgctggctgggtcgatctgtaaaaaaaatcactatatatatagtgtgtgtatacatatatatatagtgtatatatatagtgtatatatatataatgtatatatatagtgtatatatatataatgtatatatatagtgtatatatatataatgtatatatatagtgtatatataatgtgtatatatacaaatatataatatatatatttgttcataatctttaaatataatcttccttataaaagaagtctgaaagcaaagcctcataacttttcagttcattcatcaattcaatttgaaggattaactcctctccagaaaatagcaaatatgattatcctacagtgaacatgacattatctcagcaggtagaatggaagtatatggattttattctctgcaggtcccacttgatatttcaccaaacattctaaggtgagtttttagtatccaagacattatttaatgaaaataaatgtgaagctaggtcaactaaatttctgatgtcacagaaaagacgtgtatactcagaatctgaagatggcactttgttttctggcgtggaatacaattttacttaagtaaaaaacatttattgtattgataattatagacaatatattatccaggaaaatcaatgatatgtcttacaaatagaaactgagcaaaaagaggaatataagatctcattcattaaataatcaataaagtgatttaaaacacttcaaatgtaatatattggccacatatagatcagaccagatttatttagcacaacacaatcttcaatgaaaaatatgtatatataataccaacttgtggttggttttattttaatattcaagactaataaattaaaagtcttgaatattaaaagactttaataaaatcaaaataaaaaaacaaaaggtgactttgttcttataaatagcattattatcattgctactaaacaattatagttttcctccacaacagtaactacaaagattatagatatgaaacagtggaggaaaaagctttaaatctaacaactctgagttcaagttatggtcctactacttgtttactaggggagtggaagtgggaaaggggactgctgagccaagtcaattatcctatttcagcctcagatttctggtgtgcaaaactaaattatgcaaaagtcatgatgctattgttaatattagaaattatatatataaaggagctagcaaggtatctggtcctagtgtatgctcaataagtattatcaatcatctttaattcctcttcagaataacctagcacagatgaagctattatttaaaacgcactcaaaccttacttggctcttattgtagattctgtaactactcaatgtataaaagtattctatatatttcttctaagaaggagcccttagctgtttatcaggttcaggcatacagagtcctccctcagcatccatgtgggattggttccagagcccataaggatactaaaatctgcagataatcaaggccctgatagaaaatgagacagtatttgtatataatctatgcatattgtctcatacactttaaatcatctcgagattacttgtaatacatataaaatattaatgctaatagttgttatactgtagtttagagaataatgacaaaaaaagtctgcgcatgttcagtacagatgtaatgttctccccaaatattttcaattgttgcacttagttgaatctactgatgtggaagccgtggatatggagggccaagtgtatatttgctttttggatatattaagtttggccacatccaactaaatgtgtccaaaattaaattgatgtcctcacccaagccatgtgcacccctattgacatcaacatgacgtcaccttaagcaaaaccctgggaaatattttatcttatttttgacaaatctatttctctattcttcctaacatacccagttcaaaacattagcagtatttcctgtagactcttgtgcctctgctcccctaaaatctgcctcccacagagacaatcagatggattttacaaaaacatgttttctcacttgactttctaatttaaaagtctttccaagaattcctcctattgactagataagtctaagtttcttataaaagaaaattaaattttctgtggcatggccttttaattttccagccccaccttgaatcagtttatgccccagtaacactgactaataattatctataaacaagaagctatttcagacctttgaggctgtgcaaatagggtcacatacttctttttcatttggtcaacctcatcctcttattgtgggatgacttcttggtactccttcattatcgtaagttccccatcaataaccccagaaagcccagaatttaccttaatctcaaaattgctatgctaaactcaatttaatttatattctttatatactttactgtattttgggggctttcaaatgatggtactgtagttatctttgttttccagaatgtagtaaatggtagtatgtaataaatggtttgttgggctgaaaggaaacttttcctatcacagacacctgaaggaaatgaggccattgagaaatctgagaaaagatccatccaggctgagagaagatgaaaatcaagctcaaaagcatataggtagctatgatcctcagagatagagaggagactggtgccacaactggaatggactaagaaaagcagagttgagtaggagatgaaatgtataaactgttgacatgagggagtgtcctacctgtagtgatagctgacaaatttcactgagcccttttgaatttattttaatgatttgccttttactcagagtgaggtgtgaaagcactggaaagcttgagtaatggattgagatgttttccatgttaccaggatcacccaggctattgtgttgagaagagattgaagagagcacaggaagacttgtaattggaagaagttttcaacactctagactagagattgcagtggcttggactggaatgctaataaccaaagtggcagcagttgttgctttctgaatacatttttagagtagaacacagaggagttgctccaggttatgtgtggagttggggaggaagaggggcattgaggatgactctaagggtgtttggtcagagtgactgcaagatgggagacgccttaaacctcttattggatataaagtcaccaataagtttgacaggagtactgttgaaatgaatgtcaggcatgtaggaagtaaactcttccaagtgtgacttccagtatgtagatgacaataggatatgaggttagaaagaagaaaatttattgggaagagacctatcatctgtcgatgacagcaaggaggggtaatgggcgttataattattttttgacacgagattcaaaggaaaacaaactattgaggaggaggaaatctagtttaaaaatgtaaatgagaatctaatactccaccaaccgtatctctgtgattaatgatgatcacacaccctgcaaagtttagttacagtccatcaagtttcctacacctggtgtagtattgagttatctgacaagtttgatctcgtaagattcttgagacttccttttttttttgaactaatattagtaaactgtatcttttagaagaatcatccatttctgttttcaaattttgcatacatttaagcaaagttgtctctgaatcctactttttttctatttatatgtagtttcttcattagattttattgtatacagttttacttgttctttttttcttgattaggttagatagtattttatccaattaattatgtctttatttttgttgtttctttccagagaaccaaattcagtctcatttatttgttttatatatgtttataatacattcatgtctgatattatagttattaattattttgggggatttcttgtgtttttatttgtttcttttatgaagtattatgacaactatacataatcttgataggatttctcaaaaagaaaagtacagactaattttattaaataaaataacagcaagcatataatatcagcttatttcaagagaaaaaaattatgtcctaatagaatctacaccatggatgcaaaatagatccatctaagccatggatgcaaaataggagctatagtaagatcagtcattatatcatcaactcaagaagaaaagtcattactgtcctcatatatggtagctatttatttgatctgagaaaagcaccattactattttaaaaagtcaataaaatagaaatagatgagtatttttttaacatattaatagtttttaaaaccatagaccaatctaatggggaaacactgaggcagtctcattcaagtcacaaacgagacaagcatttttattggaagtataataggaaatgaaagtaaagaaagaaaatggaggccaggcgtcgtggctgatgccagtaatcccagcactttgggaggctgaagtgggaggatcagtagaggccaagagcttgagacgagcctgggcaacatagcaaaattctgattctacaaatttgtttttaattagctaggattggtggcctgaacctgtagtccccactactagtgaggctgaggtgggcagattgcatgagcccagagtttgaggcttccattagccgggattgtgccgctacactctagactgggagacagagttagacctgggctagggggaaaaaatgtaaaagaaaaaaagcctatttacaataaaaacaaaagatgtagaaatagatcaagtaagaaatgtacagaacttacataaaaagaaaaacaaaaagcctgctaaaaaacacaaaaaaatgcatggacaaatgcaaatgcaaaatgttcttggatagaaagattcaacatcaaacatatataatatattcctaagtaattaatatataaatctcttgtgttcctaataaaaacacagttaacaacaaaaacactgaactagcttatttaaagtcaaagagaaaacttaacagaaggagagggaacattttggagggaaaacagcattgaggtaagttagtagcaccagaggatagagcatactatgtaagcttaatcattaaaattgtgtggtaataggttataaaatataaataatagaattgaatagaacatttagatcaaaatcaaaacacataagaaaatatatgatataataaatgcaacatctcaaatttgttcatcattggatgaatatcacaatgtattgtgtggggaccacagagtatttgactggaaagaactatggctgcattaatacctcctactgtgtactaagatacatctcaaatacaataaagatttaaatatacaatatgaatccacataaacactagtagaaaacgtagaataactgtaatctgggcttaacataccaatataaaaaactgatatacttgcacatattcaaactgatgcatgttgagtgttaaatatttctccattgtcaataaaagaggataaatcgaaaagtttatcaataatagacttcttctacagttttatacttattaaggaatatgtttatcaataatagacttcttccatagttttatacttattaaggaatattacataactgtgaaaaaaataatctgaaggatttatctagtatctacatggagaggactccaggatacattcattgtgaatggaaaaaaaccccagcaaagtgaaggaatatattaatatttattcatattttcttggaatgatactgaaaatctggaaataaacaataaattaacaaaagggatttctcaggtgggagactagaaagatgcaattgtaatagcaggaaatcttttagcttgctgtgtgtgtgtgtgtgtgtgtctgtgtgcgagtctgtgtgtgtatacacatatttaaatacatgtattattttacataactattttaattacctatacactcagaagtgactttgaaaccctgagacattacatgccactgacacatctgttaatttctttgaagaaaagagcctttctctgtctgcagccttacttttccataataaatttgaaatatgcctctgatattgtcctcttcccaaaatttaaccaaatcagaatatgcatgcagttcctgagaatctggtctctctgattttctgatctaatttagatgtttataggataaaagaatacttgccgcgcttcttaaatttaattacagggttaaacgggcccgatgaaaagactgcattggttctaatataaattaccttcgctctgcaggaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaggcttatctttattttaatttaataaagggaaaaagaggaaagccctaacagaaaatctaatatccctataggaaatttatttttcctgtcttgccttgcattcttgacacataaactcatattaaaacagactgaacctggaaaaaatgaaataggcatagtcggcctttgttactcccaaccttccttttactctcatttttccttccataatgttctcctccctgtctcccagacactctcatctttgtgtcctttttgtttacaattgctctaggaaaggttattaacttgcacaccctgatttataaaggactgataagtcgtagagtattaatgtgtcaacaatcaaacaaatgcatctcccattgtagaatatcaagggtaacatagcccaagaaatgtttctttggggaaagaaaatctattcggagcccttgaaattaagcatgtaaacatctgtatagccaatttacatatatctataatcattttgaaggaactggtatctaaaagactttatttgggatattatatgaaaagataacaatgattaacttcatcaagcaacattaaagcaacagtgatttattatattaaaagtggctccttgacttgctgataaatataaattaaaggggaaaaagaatataaagggattctagcagaaatcttatagtaagcattttacatacatcaatagtattttctgtattcatcatacaaaaagtgaagaatgaaagaaagtggtctcaatttacacatgagggaatataattaaaagttttctgtggaataaagaaaacacatgtaattgtagtaaattaacctacctgtagaaatgttttatttacttatatttatattttcaatacattacttctaaaaatagtagtttttatagtttgcagactcctttgaaaatacagtaaagatgctggtataccttccttgatcaaatgtaaacatacacatttaccttgaaacttgaattcaatttcagaaacatcatattaactaatttcccattcaaaagttcatgtttaatatcctcaataaatgtaaacaaagtactttatacactgtactgtgctgaaggggttatattatgcatattctattttttattatatgtcatgcttagagtgataatgtccatagacatagcagcaaaaaataattgagaatgaaaaaggaaatgacattaatgcaactaagtcctgagactggctatttgggggtggacagatgtggttgctggaaggaaaggcattttatgacatgattctgcgacttgtataagcctgacagacatattcctaaaggcaaaggagaaacatttgcagaaacagtcaaaatgaatggcatatatttatagagagctattcaagccagacaaactaattctgttttgtgtatggataaaattagaaaattagaggatggggataacagaggagatatcaattttgattatacttaaatcacttaaaatgtctcaggaaatcttaattaaaatttagcacaaattggattcaatattaacattcttcctgggacttaaattggctaaaggaatgtaatgataaatggcaatgcatcaagttaagaaaaggtgttaaggagtgtgcttcagggatgtcagcattatagctggtcttatttaacattttcataaatgatgttggaagggaggataagctggatgataattacattgaagaaggtacccacctgggagatgctagaaataccaaatagtactgcaaaacacaggagacagaaacacccactaaattgcagagatagtcaaccacagttgagctaaggtattcagggaacacaattagctctgcagaaattattaggaggtagaaagcttaacaagtacacaaaataaggattctatgtttaagttacctagataacactatttttcagtcttttactactaaataataaaataatgggttatgagtcaatataatttgtttgcatgtatgctaacaaagatattttaaggaaattaatcgtagtccaccgtcagaaaaataagctgagacactgattctgaatacccaaatcataatagtgtcttccatgtaagatcccgaaaactcaagacctttttttttttaaacctcaacattagcaggagaattgcttgaacctgagaggcagaggttgcagtgacctgagatcatgccactgcactccagcctggcaacagagtgagactcttaaaaaaaaaaaaaaaaaaaatccaaaacctcaacgacattacacagtagatgtccccttctgaagtctattagatgatgttgaatggagttgtagttgctaattttggagctaacctatggcaagaatttaattcaattatagttcaatgactctgtgaccagtagatagtgtctatgagatggaaatatatgaagctcatttctaatttagcagggaaatctgcttcctaaatgaaaagggcatttatttacatggggaggccaatattttgcttacaagtttcagatgaaagtaaaaacaatactataactttaaagtgtttattgaaacattgtgatatctaaaaggtaagaaattgtgagctatttgttttttttatttcttttcgatgatgttttatagttctattcaggaactttagccctaccctttcataattccttcctctcagtgtttcaacatgtgcatattccaaatgtccccatctgtattagtctgttttcatgctgcttataaagacatacctgagactgggtaatttacaaagggaaggtttattggaatgccacgtggaattccacgtgggtagggaagcctcataatcatggcagaaggtgaaaggtgcatcttatgtggcggcagacaagagaagagagcttgtgcagggaagctcccctttttaaaaccatcagatctcatgagacttgctcactatcacaagaacagcacaggaaagacttgccccaatgattcaattacctcccactgggtcctcccacaacacgtgggaattcaagatgagatctgagtgggaatacatccaaaccatatcattccaaccctggcccctcccaaatctaatgttctcacatttcaaaaccaatcatgctttctcaacagtcttccaaagtcttaactcatttcagcattaactcaaaagtccacagtcaaaagtcccttccacctacgagcctgtcaaatcaaaagcaagttagttacttcctacatacaatggagatacaggcattgggtaaatacagcctttccaaatgggaggaactggccaaaacaaaggggctacaggccccaagcaagtccgaaatccagtggggcagtcaaatattaaagctccaaaatgatctcttttgacttcatgtctcacatccaggtcatgctgatgtaagaggtgggtttccatgctcataggcagctctgtccctttggctttgcaggggacagcctcccccccaactttgtttatgggctggcattgagtgtctgtagcttttgcaggtgcatagtacaagctgtaggtggatctaccattctgggctctggaggacagtggcactcttctcacagctccactggtcagtgccccagtagggactctgtgtgagggctctgactctgcatttcccttctgcactgccctagcagaggttctccaggagggccctgcccctcagcaaacttttgtctgggcaaccaggtgtttccatacatcctctgaaatctaggcagaggttcccaaacctcaattcttgacttctgtgcacctgcaggctcaacaccatgtggaaactgctgaggcttggagcttgaaacctctgaagccacagcctgagctctatgttggaccctttcagccatggctggagtggctgggacacaggacaccaagtccctaggctgcacacagaacagggaccctgggcctgcccatgaaacaattttttcctcataggcctctgggcctgtgatgagagaggctgctgtgaagacctctgacatgccctggagatattttccccattgtcttggggattaacattcagcttcttgttacttatgcaaatttttgcaggtggctttaacttctccttagaaaatgggattttcttttatattgtgttgtcaggctgcaaattttccaaacttttatgttctgtttccattataaaactgaatgcacttaacagcacccaagacacctcatgaatgttttgctgctaagaaatttattccgccaggtatcccaaatcatctctctcaagttcaaagttccacaaatctctagagcaggggcaaaatgccaccagtgtctttgctaaaacataacaagattcacctttgctccagttcccaagaagttcctcatctccctctgagaccacctcaggctggactttattgtccacatcactatcagcattttggacaaagccatttgacaagtctctaggaagttccaaattttcccacatcttcctgtctttttctaacactccagactgctccaacctctgcctgttactcagttctaaaattgcttccacattttcaggtatgttttcagcatcaccccactctactggtatcaatttactgtattagttaattttcacattgctgatatagacatacccgagactgggcaatttacaaaagaaaacaggtattgaaattacagttctatatggcggggaggtctcacaatcatggcagaaggtggtagcagataagagaggagagcttgcgcagggaaacttccatttttaaagctatcagattgtgggagacttattcactatcatgagaacagcaagggaaaatcttgcccccatgattcaattacctcccaccagatccctcccacaatacttgggaattcaaaatgagatttgggtggggacatagccaaaccatatcaccatcaatcacccatgtgaccacaaaataatctaagttgctcctaatgtttccttttaaattttggctgcagtttactactctctttaattgctctttcctggttctgataaaaaaaatacagcttgatataaaaggacaaatataaagatgattgaattgtgcataagctgaacaaaaacattcaaattggagtctcaaaaatgacacagaaagccacagttgatataaaccatatgcaagaatataaattgtaatgcaagagtgtaaacacggtattttatatgaataaatatattttttattagaagtgaattatgggccggaagctgtggctcacgcttgtaattccagcactttgggaggctgaggtgggcagatcacgaggtcaggagtttgaaatcatcctggctaacacggtgaaaccccatctctactaaaaatacaaaaatattagccaggcgtggtggcgagcacatgtagtcccagtgtttttgggaggctgaggcaggagaatggcatgaacccaggatgtgaagcttgcagtgagccgagattgtgccactgcactccagcctgggtgacagagtgagagtctgtctcaaaaaaaaaaaaaaagtgaattatggcttaattgataatgcatgaatgtgttgatcatttgatgtttttgcctcttgggcatccttggctcttgcttccagtaaaagtcccttattttcctttggggagcaattggcaaaaaaacatgtcaagttattcaagttggtatagtcaaggtgactcctagaactactgtaaaagagtgtttttttcttcctctagggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaaatgctaatttattttgaaattatgtctttcaaccgtaagaaccctaaatatataaaatagttttgatgcttaactactcttcttggtttgctttttgattatttttctaggattattgtgcttcgagattttggtttgagataccatgtaatcattaatacaataatgtaatatataattattcattacaataggcaaagatattgcttgaaagtggtagaattgtccctgtatagaaataatattgaattactcaataagtaaaaaaatacagataaattagctggtaaatatttccatcaagagaggacagactcgatttcagggaaatatttaaatgagtattgctttgttttttcttcttcataatttcatggatagaggattcattcttacatagatatgagcaacctcagcatacaatttttttcattattaagatgagaactttcacattttaacttaaaggaagcactttcatagcttctctttgatatatatgaattgccagaatcactactcctgtgctttgggaccattgttatgtaaaataagggtaccaccacaggtaatctaataacagagatagcttctaagtgactcatgggcagggagcatagatgtcctggagatgctggacaaaaggatgattcatgccccccccaacaagctggggacagagtaggacacctcaagatttcatcacactactgaaaatggcacaaaatttaaaactttggaattgttgatttctagaattttccatttaatgttctcagaatatagttgaccaaaagtaatagaaaccatggaaagcaaaactgaggacaagggaagaatactgtaaaaataaacatgaactgagagatttacctcacagcatatgtaaaattaactcaaaatgcatcacagacctaaaggtgaaagctacactatgaatactaggagaagataatataggagaaaatctttgtgaatttggttggcaaattttcttaaatatgacagtaaaagtatgatacaataaaaaataaacttcctaaaaattaaaagctttttctctaccaaaaacataagaacatgatacataaaatacagattatgtatttgcaaaatatttgcagatcatatatctgataaaggacttgtatttataatttatagagaatacttaccagtcagtactaagaaaacaaacacaaattttttaaatgagtgaaagatttgaatagatatttcaccaaagaagatcaataaatggctaataagcacatggaagtatctcaaattaatttgtcattaagggaacacaaaatcacaatgagatactaataagcatctgtataatggctttaacaaatgaactgacaatactatcagagaggatgtagtgggtggtaaaatggtacaagccactgttattaaaaagcagtttgacagtttatttaaaaagtatatatttaccatgtaatctagcacttttcgtaagatatctatatataacaaacagaaaaataaacatatatgtgtatatatatgtgtgtgtatatatatttacatttccaaaaagtgacttatatagaatattcacagtcacattaaactggaaacaactgaaatgcccatcaactggtaaacagataagcagaatgtgttttcacaagatggattctattaagtaactcaaagaaacagatatatagcattgattcatgccacagcatagatgagctacataaacattatgctatttaaaaagccaggtaaaataaaagtaaaagatacatactatgggactccatattttttaattcctagacaaggaaaacttttagaggcagaaaccaaaacagggggtgtctacagctgaaaatgggagtgagcattgactacaagtggtcatgagtaaagttttggggtgatggaaattttgggggtgaaagaaatgtatagaactagattgtggtcattgttgcacaactgtctaaatttactaaaaccagcccaactctttcatggaactgatgtttactggtctttgaataaacacagaaattgaccccccacccccaccccaccataccctgtcttgaagcttgaaacttacatttgtctcatgggagtttcttcctcaggacactaaccctcaaccctcctagaaaccaaggaactgaaactcaccagataactgtatccagaaaatgagatgccagacctctcatccatggattatgattccagtttaccaattcctcttccttaccctaccctaatatttgtttttgcacaagtattttttccctgctatataaacccctaattttaatcatttggggagatggatttgagactttatctcccattctcctcagctgcagcacctgattaaagttttcttctctggcaatatttgttgtctcactgattggcattttgtgaagcaagcagcaggacctagatgaaacccttgatgttttggtaatatacatacatgaggacatgtaaattataccttaataaagttatcgaaaataacaaagataattccacccacacatctgacctttttaatgatatttatccatttttttctgctacattatagaatgcccttcaggctacttgttcatgtattgtttcatcatttgagtaactttcttccttcttcctgccttcttatgcacctcacaaagtttagatcttgattatttgtttctttctttctcttttaaaccactgtatgttcctctgccttcagagactttactatcaactccatgaactccatgctacctttgtaaaactacttcttcctcctatgaatggacaggtatgaaagctctggcaagcaaagaaaagccagacccatggaagaaaagcagaatgtaatcagctaatccaactatgaaaggctgtctgtgttgagaaaagtaatcagtagaagagaaggtgaaattgtggaatatagaatggagagcacacaaacaaagatttcaagataagataccttcatattttcctctgagagaacattttatagcaagagtataatcttcttagcagctcccttcagatgtggtaatgattaatggccaatgctggagaattgcacagatttggcagaaatcaaggtacaagatatacttgagaactctactgggatcatttggggttaatgtctccttatgacatgccagaatatgagataggattgtatcacttgggcctttttcgttggttatatttatcctaattttacatttgaagccttgagttaaattctaactttgaccttatctgatatgcagtggctggcagccatagcttatacatgtatagatatgtataaaaatgacatcacttaaggcattcttcggtggtttcctagtatgacagagtcgatttttcttttttgcctcaccagatgtgtttaagtgtgggatgaaatataaacaaacgtttatggaatcagtattgtaaacaagaaggtgaacagtaaagttatatggtgaccccatatcctgatgatttgttcctagaaattctcaagggcaattataaggatccttttgcacactcaggttgaacttcacctagaagtagaatatgcctaatctacaagcttctgggagaaacaatacttctgtatgcacacaatatacttgaatcgtattcatatcatatatacttagaggaaatgtatcagtctattttcacactgctataaggaactaactcagactgggtaatttatgaagaaacgagttttaattgactcacagttccacaggcttaacaggaagcatgactgggaggcctcaggaaacttacaatcattacagaaggcaaaggagaaggaagcaccttgttcacatggcagcaggagagagagagagagcgagaggagaagtgccatatacttttaaaccatcagctctcatgagaagtcactcactatcatgagaatagcatgggagaaatttgcctccataatccaattaccttccactaggcccctactccaatactaaggttcacaactcaaggtgagatttgggtggggacacagagccaaaccaaaccgaggaacaatccttgagtcaccttaatcaacactggacataaagaactaagagggatttgaagttcaataaattagtttactgaatcaagtagagatggcttttaggcaaacatattaacctaaataagcagagtagggaacattctttttcaataacttggcattactcaggaatgattacagagtaatcaatgattactgaaataacaattataataaattctgatgtatttaaatggttctagttggctatactagaagatcaagtcaggagggacatatctctgggaactacggacaatctaaactataccaagatgtcatttgtaagtatgggcattatcaatcttctattacagtcatatttctatgaactaggaaacaaacatcttcttcatggtacctttggcgaagtttggacagactaagaatcaatgcattgctttattaaagaaaagtgactggtgtgctgcattcatatgcagaagctttcgctagtgaaagtttattcctaggggatggtttatagttatgctatcagaccagatgcagaattgtcggagaaagagtatctaatgactactctggtaatgtaaaatgtatgatatgtaggaaaagtctattttttgctaggaaagttgagaaaataatttggaaatattaaagtgtattgtgttaaatatttcatctctctgcctcagctctatcgtgtgataagggatttttaaattcatttatgtagttagataaaaataaaatctgagtgcatactgatctctaggacagaaagattatttggatgggcaacataaaacttacaactaggtaatccttatgtagaaggatttgccagagaaagaattgaatttacgtgtgtaaactaatatacccagttgaatgtatcaacacttataaaaaggcagaagtaatagaggataagggggaaaaattgtctttcaaatgttaaagaaatatcagaacagttaagtgaatctatctatggttgttaatttgctttgtagagggaattccaacttcttagtgtatgaaatatgctctggtgatagccagtgttttaacatctatttttaatgcactagatattatagaagttagtgtaacaaaaattttaagaagattcctcagaaatgtgtagcaagtgggtaacacataatgagtgcagatgacttagaagtcataagatattatatctaaagttacaagacttctactatgctattgccatagaagctatattgttgcctgcctggtatccttaattaaagctaaatcaacttggagctgtgtaaggtctactgggtctctccaggttggcattcagtctgaacctaaggctgctgctcattaaactatcactggaaattcactattcagtgtgatttctgatggaaaaatgatataatgggtttgcttttatgtttgttgatttcttcatgtgtcaataacattcaggaagttcttcaataactcctgctggccaagcaaattggggattgcaaatgtatttattttcagatttattctctgtggccttaatgtgaacaagtgatgctttaaagccaaaaagcataacaggctcccagttttcccccttctcttacgcatatcctagaataatccaagatgatgggcacctcagtagggtaggtggctggcaaatttatcactttggttgtataatttggaaaaagatattgataacattaataataacatgatcattaaatacttatatgaataattgtcaccgaagatgaatctcccatctatgcatttttcttcccaaaaaaaggcaagaaataaaacaacaagaagatgactttaaagcatttcttttcacagcctgactatttaaagggcttgtttcttttctgcagcaacttcatgatccttttgtaaaggttcattggttctaattactcaaactctgagactggaaactggaaccttaagtgctctaatgctatcaaattctctcatgcccaacttacactctcaaaaaaagatttcctcaaagttggcttccattaatttccatctcattagctttaacccatcgatttaaggacccagtctttcatacttcttcaagaaatctcacgttgtatacaatgccaaatctaaactactctacatgcaaggtagccatcttaaattaatttataaataattggatccatttattcagaccttaatttgtaccaaatgtctgactccgaaaaatgaagagtggaaaagaaacagaaacaataacttctgtcaaacagaaggtgctctaggaaaggagatgagagagaaacctatctttaaatgaaatgctgttacagaaacataaaaatactttacaaaagtacagaaaagcctgtcatgacaaaggggctgggagaataaaccaacatatatttgacttagtaaaagaaaagcaaatctttgagcattcagttcctcttctctccaatgccagttaaatttgtatctttaatgcctcatgaaattactatgcctttggccgtatcatttcatcttcaacatcatattatcttcacttgcctatctgagtactctaacagatcatcatccccactcacttttgatgaattctcgttagtgctcttagtctttctcatcaaatttaacaactcaataattgtgatgttttctgattatttcactgtgaagaaggattatttcttgcaaaatatagtcaactccttgaggattagggctgtgccttactcgttctacgtatttttcagagcacttagtttagtacgaatcacctaaaaatctgtgtagattaaattataatctagccaagaaagtaatacaacatgtagcatacatatattaggacttgcacaatagtgcttttgtttgtttgtttgtttcctttgccaaactggatgagcaagtttactagggttttaagaaatccctactgctctatttaaatgtttgttttttcccctaagatctcctgtatttgaaatatctcaatacccaactatttttattttactcagatgactatgcttggacattataactgtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaaataacaaaatttactaccagtgaaagctgaaaagaaaatgagctcttttttggaaacaataggtgaataaaagctaaaattgatcaaagaaatgtttcatttattggacatatactaaagaaaatagtataaaatatattgtacattttgtttcttctagagcaatatcatatttcaagtcaaatatctagtaaaccagcaatatatagaaccataagtatgagcgtgaatatagtcaaaattaaaaatacacaatttacatgattgtaaaaacaatcacatacaaataagcagaagcttcataaaaaatgcaagcacctaagcattaattattgaaaccggaccatgaaattggacaactttcactatgacaaccaaaaaacatgatacagaaatataaaagtaaataattgtgtttacaaatgagttttctttaaaaagctacactgttaagtatatcaaggaaaggggataacgtctgaaaaataatataaaatctaaatattctgttttcagttacacaaattcaaaatgcaaggaattgtgattactataatgctagcattagtatttcttcaaatttatcaaatgggaaacctcagcctaaactacataagccctaaggttttaagagatactgaaatatgtgctaaacacttaataatgtttaatttgatgatctaagtcatatttgtcatgtattataaaaccaaaatataatttgcctttcttcattagtagtctagtaattacttaaggtcataaactatatgttgatagtttctttatttcttatgatttggcatcgtgcgcaatactttaaatgctctacacaataaatcattttcaaataaatgtgttaattattcaactttgcctctttaacagcatatatgattgacttatgttttcagtcagtttagcatctcaagagtctttttgaagtgattcttctgaataatcaagtttggaagtactacgttatagggatactaatataactgtagtttaaaatattttactttgtaaaaaatttaaaaatgaattaacctgaaatataagttatttcccatgactcataaataaattcctaatacatattttacctacatctattagttctttttatccatttattcatttaacaaataatatttattaaaggtcaatgtgctgggactgtgtaaggtgttaggcatacagtagtgatagaaaaagaagaaaagtatgcaaaaaaattgacaataattttattccatttgagcctataattaagtgagagaaacagatagtttaaccatataattataaatttttaaatgtgctgtgaaggagaaatcaggatgctccaagataataaaggggtaacattgagaagaggaaatcatggaagtcttctttgaggaagcggcatttaaattaagacctaaaagacggaaagcatatgaatgaaagttatctcatcactgtgggagcatcataacaaataagagaaagataaaatgctaagtgaagaaattgaacgctaatccagtaatacaggatatcgattatgggcttcatttttatagcagtagaaaaccattgaaggggtcaagcatgctaattatttgagtgatttcaaatgtaatatagcccactggctaatgaatgaagaagagggaaagaggagacataaataatactcatagaaggacatttcacaggtttaggtgaaagttgatggtggcagtgaaagaaaaattaaggccgggcgtggtggctcacacctgtaatcccagcactttgggaggccgaggcaggcagatcacgaggtcaggagaaccagaccatcctggctaacacggtgaaaccccgtctctaataaaaatacaaaaaaaaaattgccgggcatggtggtgggctcctgtagtcccagctactcaggaggctgagacaggagaatggcgtgaactcgggaggcggagcttgcagtgagctgagatcgcaccactgcactccaacctgggcgacagagcaaaaaaaagaaaaaaagaaaaacaggtagatgcattaaataagtatatgagaaaaaattggtaggaggtggtaatagattggagatgggagtaaatgagtatgtttcaagaataactttttccaatcaaatggaaggtgttgctattttcttttccttctttcttttttctttttcttttctttttttttttttttttttttgagacagagtctcgttccgtcacccagccgggagtgcaatggcgcgatcttggctcactgcaacctccaagagattctcccgcttcagcctcctgaggtgttgctagtttcttagattggggaatatcatccatttgaaaaaatgctgatagtgtaatcaaacttggaattcaattaaagtcctaagcatgagtgaataacctgtataagttcagaattacatgttggtgtatatatttcaattctaatacaaataggtttagccaagaaatggagtggtctttagaaaaaaataaaatgcttcaaatatcaaaaataaattaaaattgtgtactaatgtaaaaataggtccacatttttgtaagctttgctcatgaagactttatccggtatttgctgaaatactgaaccccctcaagaccttaagtaaatataaccctcaaactttaatcatgacattatacacacaaaccaaagaaaacaaaatcattatttgaaagaaattgtcgtctatggccataccactctgaaccctcccaatcttgtgtgaaataaattgtcaagagacattaaaatacgatgtagttttatcttaaacttgaatatttgaaattacaaaaacagaatttaatatgtaattttatatgttatgtacgtgtcctccacagagcactaaataacacaggacactcagaagtatatacagataaggtagcaacaaatattaataatcataagtgctttacataatttatgagaatggtacagtaataatagcaagttaccacatgcagcatttgctaagcatgcatgtgatagtagtttatatagttagtttaataatcacaacactcttttgaggttggtactattattatcaccattttaaagattggaaaactgaggtacaaaaggttatgtcatgtaatggtacaaagtggcagaaagaaatgcaactagctagcctgcctcccaattctattgtctttaaattggattctacttcatctctgtcacttaaaaccctcgttaatttggaacaatcatctgtcattatattaactcacatttttctataaaattaggctataaaaataattatgttcaaagttttttcctatgatatattacctatgatatagaataactacctatgatataggtatgataattacctatgatataggtatacctatgatatagaataactacctatgaataattacctatgatatagaataactaagaaattaaaatatttccaatttaagagcaggaaggggtagcttggctaaagctgtgaagttagagatcatctcgggaaaggactatgtgaggtgatacttagtgtgtgatagaattcttacgccaaatagaacatatatctaaaattaggtgttttctaaactcattgagggtacattagtcgagggaattaaattctatggacattaactgaattcctactgtgtgtaagtcattatactgaccactcgtggttagatcattaaaagtttttgtcttaaaggaacttacagatcagtaggggagacagacacgtaaaagttagccttaacgcaagccacaataaaacatgtgggagatacagttgatagctggtacgtggaagcaattaattttgacttgctaggaaaatatagcctttattaaagaggtaacaattgtactgtgtgttaaagattttcttttttaaagatacaacttggatcaaaccttcaacctgagagagctctcaatagttacagaataagaagaatattccatgctaaaaacaagtaaaacaaaaccctatatattattctcggattcataacatgaagggatgtagcaggagatgaaacaaatatatttaagagtattacatagatgtccttgactgtatgtgtggagctttcttccttccattggtaggttttccaggagggtgaggatctgttctgactcagtttcagaataatcatctgaaacagtgtggtaggaaatccattgaaatagccagattgcccaacatagtttactgtagtagcctaaattatggcagcacataggcatggaaaaggaattggtggtggaaatgggaatgcaaattggtacagtcaccttagaagacagcttctcagtttctaacaaagatatccatattcattctatatgatccagcaatcccactccttggtatttaccaaaaggatttgaaaatttatgtccatgtaaaaaaaaaaacttagcatggatgattatagcagctttattaataatggccaaaacttgaaagcaaccaaaatattatttcatggaagaatgaataaataaactgtgttacatctagataatggaatattatacagccctgaaaagatatgggctattatgtcatgaaaagacatggaggaattttaaatacgtattactaagtgaaataagccagtctgacaaggctacatactatatgattctaaacacatgctattctggaaaaggcaaaatcatggagactgtagaaagatcaatgattgtcaggggaaggaagcaagcaagggggagggaagcataggcagagcacaggatttttagagcagtgaaactcttctgtgtggttctataatggtggatatatgtcattagtacaaaaccataaaatgaagcaccgagagtgaatcctaatgcaaactacagactttggatgataacaatgtgcgaatgtaagttcattaattgtggcaaatgtatcactttggtatggggtgttaatattggggcaggtatgcatctgtggggacagtgagtatatgggaaatcactgtatcttcctctcaattttggtgtgtacctaaaactgctcaaaaaaaatctttaacaaaaaagatgaaatgatgatctacaaatacattctaaaatagaaattgcctaaactgaacaataatttggatgtatgcaggtaaagcagagggaaaacaaacaagactgcaaggtgcctatcctgctgcctgtggaacctaaagattaatggtgtgcatcatgatatagctgcctccaacacgactagatgcatgtttttgagtgtctgtgtttgtttattaaaataaagataattgattagttaatgtatttttggatatgtgcaatttgaagtgcttgtaaaagatctactttgtcatgtccagctgatatctggaatgtcagcttgctgcttgggaaagaggtcattacagggcatttaactttgggagacaagtatatatagaggtgatgattgaaaacttgagaacagatgaaaaagagaagaagtatatatacgtatttgaagaacgttaatttttaaagggtgataattgaacaaggggccagtaacatctctcagccaacagagaagtaggatgggaaccagggaagtttttcataaaagggtatagttgagagtttcaaaaagattaaggacttttgactttgacatgtagaaatagactgatgggatatctaattttatatgattttagtggtgtgatgtgagtgaaacccagagtatattctatacaagatagataaatacagatagaaatatagagatagatatagatcaatatatgtatgcaggcacttagattgatacatttttgtcgataaggaaaataatcagagtgggatagaagcatgaagaattatatctgggagtagggattagaccagaacctggggatgttaataatgttaattgggcaaagggaagggattagtcactggagagagattattgcatcaaaaaaatagaataattggtggagcacagaaattggaaggagtgcagtctaagacaggaaagaagagtaagaagcatcacagaagaagggaaggagaactaaaaaacaaaagaacaatgaaaagaagtggggtgaggatcagaggactcaactttatgtgggattccatcttaatgacttaagaagtaccagaatctacaatgaactcaaacaaatttacaagaaaaaaacaaccccatcaaaaagtgggcaaagaacatgaacagacacttctcaaaagaagacatttatgcagccaaaaaacatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggtgattcctcagggatctagaactagaaataccatttgacccagccatcccattactggatatatacccaaaggactataaatcaggctgctataaagacacatacacacgtatgtttattgcggcactattcaccatagcaaagacttggaaccaacccaaatgtccaacaacgatagactggattaagaaaatgtggcacatatacaccatggaatactatgcagccataaaaaaaggataagttcatgtcctttgtagggacatagatgaaattgggaatcatcattctcagtaaactatcacaaggacaaaaaaccaaacaccgcatgttctcactcataggtgggaattgaacaatgagaacacatggacacaggaaggggaacatcacactctggggactgttgtggggtggggggagggggcagggatagcattaggagatatacctaatgctaaatgacgagttattgggtgcagcacaccagcatggcacatgtatacatatgtaactaacctgcacattgtgcacatgtaccctaaaacttaaagtataataataataaaataaaatttaaaaaaaaagaagtacaattattcagtggtacttttaaaatattgttgtttaaaactgtaactctcaaaattggctgcatattagaactgtttcaatttcttaaataaaatctgtctaagtgagtccgttatgggtggccaaatcatttaaatacaaacatcttagaatgaagtgctggcatcaatactttaaaagttcctcaggcagaatgctaatagtcaattatcattgagaatcacagtttaagagaattgcagatgtttgcgaatagtgtttatggagcattaattggatagctagctactagtatttaaattgacatcttcaaaatattaaaatctgtatcctgtatagggagtaattgtcttttcaagaaaactagcaatgtgtggattggtattagtggagcatagtatttattagtttcaacctatacgattgcattgacatctgataaaacggtctgcatggaatgaaaaatgaaattatctcatgcagtaattttcccttaaacaaaatatgtgctaataatgtgattatacttcagctccggttacggaagatgatgttggtgctttaaggcatcactcctctaagtgttgttcatgacccatgtgcatgagaatcactccaggctttttgaaaaaatcaagtgtaagagacatatataaagtcagaagctcaatttataactgagaacttataacaaggatctggttaaaactttataaccaactcatttgctccttgcagacagggtagatacttaataagaaaaatatactgtacttaaaaaattgagtatgcactcacatcaggctaaaagagtctcatggctacattgaaaatgacaataattaaaacctgttgcccaagtgtctctttcctttaaagtgctcattgtcacttttgtttctgacactttcagtctttgacatcagtttactaaccacaaagtaaactgatgtatcctgtgtcaggtcaatggggaaaggcagggttgtgatgaggtgtagcatagggacctatgtcatgactcttaaagggtatatgtagatcagagttctgtatcaagtttctttgttttaaaaatattctctcaatgagaactagtttatgtctaggttcttggaggatgttttatagcgagaccattcttctaccacataccagaaataacattaaaatactaattataaagcttaatttgttgacttaaataatttttaaaattgtgggcatgctgacacaaacaacagtctatcttcataatctgcatagttcaggaaaatatataaaagtcttgaaaggcaaggaaatatctgttttacaaagagatacataagggaaattaacttttgtagacttcaaatgaggaaataagcctttgatcccctaaggcaaacatttttgagatacagtttctccatataattgctatgattttcttacttacactttgtagttccctgctggctgtttttctgtgtaaacttactttcatttccaattatgtcattatagagatgaaaatcagctctaattaaataagaacatgacaataattgtcattcatttatttatgtaaactatgatttttctacctgtgaaaaggtgatttagcaaagaaaaatgtagctctcatggtccatcaattgactggaactaatagtcatgtatctacagcttcccattctctcatatctttattcattcaatattacttgtctaagggtcttcctttctttcatcttcaaataagcatttattaagtagctacactatatttattttattttataattttaacttttatttcagattcagggggtacatacgcaagtttattacctgggtatattgcatgatgttgaggtttggggtatgattgattctgtcacccagatactgagtatagtacacaatagttaatttttcaattgtctcttctccctctctccctccatagtagtccccagtgtcttttgttgccatcagcagctaccgtattaaacatctactatatgccatgaactatagatacagatgccacagatacagaaataaactagttacagttttgccctgaaatcaaatgctttaaaacacattcattttattaatgtgacaagtaccataccaatatattaaaaaatttaccatagcagtttgaaacgttttttctctctttaccaaatacacagcagaagctatttacacatagaataaacattccggtgaattcccagtccccaggctatcatgtcaccccttctatagaactcaagaaagcatatcttaattcataaataaaaaataatagcattgaatgatttcttttttctttcacattttgcttgtttgtttgttttttgtgtttttctttttaagacggagtctctctctgtccccaggctggagtgcagtggcgccatcttggttcactgcaatctccacctcctgggttcaagcaattctcctgcctcagcctcccgagtagctgggactacaggcgcatgccgccacgtccggctaatttttttaaaaatttttattttagtagaggtggggtttcaccatattgcccaggctggtctcgagctccttagctcaggcaatccgctcgcctcggcctcccaaagtgctaggattacaggtgtgagccgccatgcccagctgcattgaatgatttctaattttaattaacaattaatgcaaagttggtgatgatttatccttggaataaatatttactgcatggctaatatgtctgccatgtgctggcattacagtggcaaacaagacagccaaagttgctaacctcctgagttttccatttggagtaagggaaagaagaaaataggttaatttcagatatgggctatgaccttgatgagagaggaaaagagagaaaaaaagtgtgtgtgtgtgtgtgtgtgtgtgtgtgtgtttgaaataacttatttaagtgtaataagcacagataatggtaaaaataagataaatcaggaataaagatgttgcctgacttacatgttttcaaagttaccatttactatctaacttaaattttctctgctgtaatgattatattttatctaggtaaccaatatctagtgggattatgcatcaatttactaaggcagttttttgtatttatctccaagtgaaatttaatcaatttctacagtagtgaaaagtaatttgaagatttaatatattcagtattttaataaaatataaactggtcaaatagctatgcttttttttttaaagtaacaaccaagcatttattcacttactacaaatagctatgtttacctctaataaccagttaagtctcctttagagtccatatagatatgcttttatttgtttttggttttttgtttttgtttttgtttttttttgagatggagttttgctcttgttgcccaggctggagtgtgatggcatgatctcagctcaccgcaaccttggcctcccaggttcaagcgattctcctgcctcagcctcctgagtagctgggattacaggcatgcgccaccatacccggctaattttgtatttttagtagagacagcgttggtcaggctggtctcgaactcccgacctcaggtgatccacttgccttggcttcccaaagtgctgggattacaggcgtgagccaccatgcctggcggatatgcttttatttgaaaagtaacagaaatttaaagctatttaaactaattatgctatacaataagtgtgaaatcaatttctgtttcttaagtaatttcttcatgagcatatcgtataatgcacatgtaaataacagctttgagtgtacacttatattatgtgagtagttacctgtatgacactgtccccaggtctcatgtctgtataaacatacacatcataggatatttcagggaaggttggcgtgttatcatttgcatccatcacttgaatattgacgatgactggctcactttcttgtacaccatcaaatgctgttatctttgggaggagaaaaatacacttagtagagatgttctgcaaatataagtagtacagagtttgctcttacagtttaacaagtttcttacaggtaatcttacaatttgaaagggtgcaaaaatattttgttgataaaaggacgtaatagagacgtaatattacatatattaaaagtgttctaatatggtaagaagcaagtattgaagattttgttttaaggtattcaactccaggcatattttaaataatcagatatgcaaaatatcatttaaagtgggccaataacattgctgactcttagggttaactacaatttaatccttaaaaacttaattggaaaatattatttgcatttacatattttgtatacaatagttccttgtacagtcaatgtgtttataccatcaggaaggtagacttcctagatgtactttgtatcacagtaattcacccaatggcaattttcaaaggactaagtggtatcatttaattgtgatattttatactttatcaatgttgataatgtatgttatactttatcaatgttgataatgtacattatcaagattttaacaattcctgccaaatcagtgctacagcaccaccatctttgtctaaatccactttgtatctaacttttaacaatcacataaactttcctggaagttctgatctttttctatgtaggcttctccagaaataatttctacatatcttgtttaacttgtgctttctcttagctcatctttctcctgtgactgattcaaaaattgggatataattagaagttacattttttctttatccaactgtcaaccctactatacttgttatttacgtgtttgtgtgcatgtgtgtgtatgtttatgtgtgtgtgtgtatttccctatctcatgataaatatttacaatcacaactttaataacctttactttttttcccccttgattagcctaacccatgatttatctacctcagtgctattgacaccttgggacagataactctttattgtgaggggctgttctctgtattacaattagcagcatcctttatgtctacctactagatgcctatagtaactaccccttcacaattgtgacaaacaaaaatgcctccagatgttgctaaatgttcactggagggaaaatttattccctcttgagaatcactggctcaaccttatgactaaataaaaaatgcaagaacaacaacaaaaaaggttaggaaataattctttatacctcaatttaagacaattatgactgtttagtaaagactgaaattctcactttcttttttttttgaaaagttttttcttctgtgaggaagaatgttaatatagctacacaaattacaaaaaaagagcaatacatgtaaataatttttcattgatcttctctctggtattgaaaataatgtatttttcccccaagtcattgattttttcagttttaaccagacatctctttcagttccatacaaacatacatacatacattcatacatacatatgtatatttacacaaaagctctttaccgaaaaggtgtaagtttgctgttcttccctgtccactggttgaagtaaggtgaggtagcgagtaataccagtctgtgtgacggtgaagactgaggtgtagtcattcagaaaaaggtgaagctctgggtcttttgtctttgaaaaaaaatgacatcgtttcaaacgttgaataaataatgtagctattagttcattacctagaagttaatgtttgaaatttatagcaaaaatccacgtgaaagtattaagaatttctaacgataaaagatatttaactagatatttactcaaatgatctaaactattcaaaagatggtgacctatatcgtggaatacaaaatactgaaatacaaacaggtataatcaatgtgggaaaaaaggaaaaataatagaaaaacagaaagaatataaaaactcccaattaaatatattcttactgattatttgttatcaatattttccaaaatagcattggactggagaaataagaaataaaagcaagaaaagaaaattgcatttcaaaattttagcaataagactttataattacttcatttatagtaataaactgcatatatacatattactatcttgttcttacttataatgcaaaatagaaataaaattggttatgtattattcattacctataaatatcatgcttactctttcttattttaatgctgtaaaattttccaaatggaaacatgtttactttaattaaaatatttcagataatttgatttaaaatatgcataaatttagcaaatgtgtctgatagaaaagtctagaaaaaatgatatatacttaaaaaggaagggatttcaaaattcaagtctgagagacaatcaacttagcattgaagaccctttgcaatttcattgccacccctgaaacagaagacaacatactctaatttagagaaagaacagcaatataaagtaagaaggctagcactgatgtctgcatagtaggaaagaaaggcaggtggagcgaagaaaaaaggaatattcagagagtggactattatgaaggctttgaaaaagagagaaaggagtgatacagggaggtaaggtgttgttctagattatactatcttttaaagtatgcatagcatgatatgaaatggatttaatatcataaaacacttctttaagtctgatgtcaaggactgaggcaagagcaaagaatagaaaattgttaaatgtgtttaatttgaaaataatagaactcataatttcaaaatttctatgtaaaatacaaaagttgtaatgcacactactataataaaatgtgaacatgatttgatccacaatatacttgaatctgcccatcttttaaacattgtgatatgtgtagatttcaaataaccttgaaataaatggtttcatttgaacctaaaacaagttatgtattcataatatctcattctgtagtagcttctatgttcaggattttgacttaaggtcactgtgctacatttatcctggaacaataagaaagtaatactacacataataattccaactggcgtatttattataaaatgatcaaaaatattgagaaaaagttcaagaggcttcacactctgatattttcaaacaggcacttcagttgtttccatttcagtgtcatgaacccaattactcagataactagaaagcgggatattctaaaaaatctaacatgttagttttaaaaataaattatgtatttttaaaagtcaattagaaaatgcatatgtctattctgaatgatattttaagcattcttattttacactttagagtgaattgtgattaaattcaattattagagttgataaaaaagttttagttaacatgcagtttcagtcaaagaaactctaagtatgaatgtctgccatttgttttgtgttcatcctggatttacctaatcactgggcttttaagcacatatacacttctctaaatgcaccaacaatggtgccatctggcatgccttaatttattcggacctttaaaccctaaatgcaagctgaggaagttttgctatgtaccttgtttaccaaatatttactttgttccttttgttcaaatctcatcattctctacttcctttataccttaattctctcaatttattttcttcctttcaaccgtaacctctgttaataaatttgttaggtatattcactcatatcttcacatttttaagcatttttgtgtgtcaagtatttcgataatgcaatatttcaataagtattgagttgtcaactagtgtgtccaaatgtgactgtagtataatatgtttgtgtcacaaagagcacttactttttaccactttcaagaaaacctctaggttttgtttgtcaaatgcttttcgtttgaagataatgcacacatcaatactccataaatagacttccttatattggataaacagaaacattaaagatcttttgttaatttaactgtctcagtttcttgagtgcttttataataactagctggagaaagataacatttcccagaactacagtgtatttgctttttgtgaagaagataatctatcacagaaagctagcactatacatggcatattatagctcattctgttttgtttagttaatctctgatcaaaatataacatttacatttatgtatatttaaaataataatcttgtacataaatgctactggtaaatatcctcgtattaatttaagtaaaaaaatttaggaagccagatttggaaatgttcaacaaattgtcactcaatgtttaataatttatattcatttttaaagatagtgcaagtttcaaatgttgtgtatatatttatgttccaaatattacagcatatcattttatgagttttatgaaaattttaagtaatatcaacataaaatgttaatagatacatatcagtaccaactaacctattgttttgattgacaatatttacagttcaaggttttgctacccttcacaagaaaggtgtatcaaaggtttggtaagaaacaatgtgcatttgaagtcaaatatccttctctaaatctctttataaacttaaattccttcttgtcaagctgcattccgatacagtttgaatttcacaaatatatttgaattttgcaattcctaaagagtaacttgagtcaacacttgtatatttgcaactcttttaatcatgttagagttaatagcttataagtttcatagactaggatgtacatggacaaataatgctctggcttaatattccaataggggtagcagactttaggtagctgttgtgtctataagtttatttaaaatgaatttaagtgttaaatcaataggtacacagagagttgattaaaaaccgttaattttcctctgacattaggtaatatttattttaccctaaaatatccagtcagtatataccaaaagtatgatatattaattcacttatctgcatattatattttgagatggtaaaataagctctgacatgcacacataaaaacagaaaaaaatgcaaaagtaaatgcatatgaaaacacacaggtaaacaaacatatgaatataaaataaacaagcattctatcatataaaactatgttcaaagatgagagtctactgtttaaacaccaacttggggtttctaatgggaataaatataggatatcacaaacacacaagaccatatgcatgcacatatataggcacatacaacacagacatgtatagacatatgtgcacatatatatgtatgcatatacaagagcatacatataaatgacaaagcataagagaaaaatgacaaaaaaatgttatctcctcagccagttttaattacttggtagtagttgcctgagtatttagttcaaaaaaattcaatttcaaacttacaatgttttagaaaaaatgccatgataaattaccaatgtttgttgtggactgagaaaacattaataattaagcagtctttgcctcagttgacaattaaatttggattttacaaaatttcatagtactataaacaatagattatgtaaatatttttaccttttttaactttaaaatatttttaaattttaaaccaatgaagtaagtatatttaaatttatataaagtatttgtagatatccttataagggataatgaagtaatacctacgtgttttagtgaagaaaaaaaagaacaaggaaataaaccacagcaattaacaaaagaacaatcacaagcttaacacctagtacctacaggaactccactgggtggaacctatacgcaaattaaacatgaaataaatattgtaaatgtaaatgatcacaaccgcacatatgaagaaaaagcaaaccacttccagcacactagactgacaatttttttcagagtatacaatttttttattagcattgtgacccacatataatggaataacgatatttatgaagcatataaatacttaactgctttatgagtatattgaattaaatatcaaagatacctcttcatagtaaaataacgttaagcagagaaacaaatttacatgaagttataaataagtatctttttacaagccaaatgagtaatctttattgattattattctttgtcattttttatgatcagcattcaataatcaatttttagcatctctgacactgaaaacctggtggtctcagacatgcctcttaacaccttgtgccttacctattctacttatattatgggttattttgaaattatgatgtggtacaagtactctaaaaggcataatgtataaactgatatggttcatatatgtatacatgcatgtgtatgtgtgtgtgtgtgtgtgtgtgtgtgtgtgtgtgtgtatgggtatatgtctacatctatatagcaataaaaagaacactggtgcaaatatttcttttcctttcttttcagtattactgtggcccttggaattctttctgacttaaaatctacactgtgaatactatcacaactcacattcctggctattgtttcttaaaatgtggcttcactttccactaaattaaagggagaaacacaacttaaattttacgcaaatggatccaaacttgtccccttcttggcatttaccatctggaatagctatgcttgaagcaactcttgagagccaagccctgcaatgacaacttccacttttatgcttgaggcttaatctctaatactatgctgatattgtatgaggtggcacactgtctctctcaaagagtttatccctataatgatgattgtcactaattctgacactcaaaagcaacaggattttgtttcattttgttgaattagggtcccaatttgtcatctagcctgcagtgcagtggtgcaatcatggctcactgcagcctcgaaccagtgggctcaagggatccttctgcctcagcctttcaattagtgagactacaagcatgaaccaccatgcctggctaagttttttgtttatttttgtagagactgcatctccatatgtagccaaggctggtctggaactcctggcctcaagccatcctccagcctcactctcccaaaatgctgagattatgagtgagccaccacacccagccaagagtggcatgatttaccttgaagtaaaattcatgcccataaactaaaatggctttaaagttttcttttcataatacagatcttttgaaaatcccagaaatgaactaatttactttataaaaataaatggtgctcggtctataaaaaacagatgtatcagaaggacataaatccatcttctaatatatgaatgactatttcatagatttattttgtgtgctggcaaatggaagatttaaggaataatagatgaattaaaagaaaactggtttcaactcagtatgaaaaacagctttctaagaattagagttgttcaaacatgggataggccatcttgtgaaatacttaatgcaacatcattagcatctttgaagcatctgttagataacctaattcattcaatagtgactgaatttatgagtttattgaagagttcccaaaccctattaagtgctggaaactgtgttagttcttcagcatacaaaagttgctaagatataggacctattctcaacagatgtaaactcatgagggagaaagacattattttcaagttggaagtatagaattagagaaatgcactgagggaggcatgcaactaaaattggataatgaataccgtggaaagattctcgaatgaaggaatgcctgaggtgagctctaaacactgagtataagttatccaagccagcctgtgcaacagatgaaagatttcaaagcctagaacatgtaatgagcaaacattagacaagatgtagcttggcacatgaaagaaacgacaagcagttgccaaatgttataggtgaattaggaagtttccaaaactcaggccacaaaaatgttcaggtatcaagatacagaaaattgtgtgagcttaaattttcttctctagaggaataggtgtcataaaagtatatcaaatagaaatgtgggccagacgcagtggctcatgcctgtaaacccgagcaaggtgggtgtatcacttgaggtcaggagttccagaccaacctggccaacatggtgaaacactgtctctacaaaaaatgcaaaaaaaaaaaaaaaaaaaattagctaggcatggtggtacaagcctgtaatcccagctacttaggaggctgttgtgggagaatcacttgagccagggaggcagaggttgcagtgagcctggattgtgacgctgcactccagcctgggtgacagagagaaactctctcaaaagaaagaaaagcaagggaaagaaaaaaaagaaaagaaagaaggagaaggaggggaaggaagggacggggggaaggaaaggaagggagagagaaagaaaaaaataatgaacggagagaaggaaggaaggcaggaaggcaggcaggcagaaggaaagaagaaagaaacaaaggaaggaaggaagaaagaaaaaaaaaaaagaaagaaagaaagagaaagagaaagaaagaaagaaaaagaaagaaagaaagaaaaagaaagagaaagaaagaaaggaaagaaggaaggaaggaaaaagagaaagaaaggagagggagagagggagagaggaaggaaggatgtagttagatgttagatttgagcttttgaataaatcactctaatggccctgcagaagatagacttgagtaagaaatcaagagaccaagaacatcaggaagtaattctaataacagaccaatagggtggtggttataaggatagagagaagaaaagagattaaataaataattaggggacaaaataggaagatctggaagatttcttagttgtggcgaataaagaaaacataaaaatcaagcaagacttctaggattctaggttgcatagcacaataaaacatctatcaatttctgggaaatgggttttaggagaggatttcatacagtactggaagtttaaactatttctaatattctatgagcttatttatattttatatatagaaactacatatgatatttttaaaaattttattactagaagactaggcatacttgttcactctctggacacctaatgacagtcactcaccatagattattttagaaagggggtgagtctaagtaataaacaaatgatcagttttgctgattaattacttgacacttttataaaagttatgaagcatgccaccctccatgtacatggcatcatctcagggaaattttctctccatgccctttcctaccagtcccaactaaagacacataccaaggcagcaatgattgctaccatatagatgactggacaagagggggcacctgatgagtatgaaactcacaatgttatacagctattacatgacagaaccaggagtcaagccaagatctgtctaaatccaaagcccaaactgccaaaaacacttcagagcatttcatagactaactggtactgtacatctccaagagttgaattataagtagtgtttctcaaaggttttagacccctgagctctctccactttatttcatcaatgccctgtgagtactactgtcttttacaaagttccttggaacacaattttaacatttgtaatttaaaagtgaacagacaatccagacaagtacggggtcacataggcaagcatagggcttagtgtgtaaccaatagataatatgaacacactgagaaggtataaatacataaattttgctattgtgtaaacttaaaactacctaactttagatttagatttttctaaccaccagttctattaaggtatgacctaagctatcatacactttcaaattgattagtcactacttaaaatatgagtatgtattcaattgaaaagcaaaatccgcactaaaatttgtgggacattagtagatctacaaaatacatttgctcagcctggattgaagttattaaggtgactctaggtgttttctagtggggattcagtagagacttttttcctgtgactcatgaaacccactatacatcagagaatccctaaattctcttgactggcatatgaaactgtgtatagattaatgtgttcacttttctaggaaaagaacctagagcattcttcagctatcattatagtcagactatgatcaaagtatataaaatatagagtgcttaaaattgagaactttgttttccataaaccttggcttaaggtccatttctactgtttactaacactgtgatcatggtaaggcatttaaactagctttaatatccctttctgaaatagggataattgcatctatcatgtttgttgtgagatttaagggaattaatgcaagaagaatttactgtattgtttgacatgtactgagaactcaatgacagatattgttaaaacttgtggtttaagaagacactaaatgtgagagaccaggaaagattgaaaaaaaaaaaaaagctagaatggaaaaagaaaacaaagcaaagagaaacaaaagaataaaataaagcatctggtgggaagaggtggagtgccaacaagaattgtcatagcctctgtggagtgttacaaaatttatttagaaagagaaaaaaaatctgaaagtgccttcctaatttcctgaagtgattataaagctatgtgtaatgagatattagggaacattctagagctctgctgccttatgagtgacatgtatttatatttaatttcattaatattaagcaaaatttaaaagttatgtttttagtccagttaaattttaagtactcaatagctgtataagactagtggctactatgttggacagtacagttacacagtaattccatcatcacaaaaaaatccatctatctgagagcaagcactgttaagggagaaatgaatgaatcaagaattatataacagcaagtaagaaatccaactatcttttacatatagttatgcttataatccaaacacagttgtatttacttgctgttttatatatatgtgtgtgtgtgtgtgtgtatgtatacctgtgtatatatctctatctatctatctatctatctatctatctatctatctatatctgtatgtgtatgtatacctgtgtatatgtctatctatctatctatctatatatatacacaaaacatatgtatacatatttatgcagtgaggatactgtggtagttcacaaactcaaaggaaaatctttgggaattagaatacctctggggaacttaaaacttaaaagacaggcactcaatgggactctcttttctgtgtgtatctctcaggcttcattctctcccactgataattggctttctcatgatgtcagcaaatgtggctacaaaggtttcagattcatttccacttctctaatacatgataccaaagtctttcagcccttctgttctccattgtaaattcctgggaggattctggctagcctggtatagattttctgtccctttataacattcactctggctaaggaggtaaagtgttctgatttgctcagcctggaccatttcccactcatgtagatagtgtgagtacaagaaaaacaaaagacaatgatttgtggagtgaagcgtaagcatccacatagtcactggcagaagtatgaatgggtcagctgcctcaaatatattttaataacgatgccctcagacttgaagaaaagtctctgagaatcacaatctaggggtgctttcatgattttttactcatgtagtaacaccattatttttgctttatcaataattatataaaacagttctcaacatatgttaataaaaatattgccctcgtcattaaataaacatcaagtaaaacattcattttcttacatatactgaatatctgcaagctgaaaaggaatagttattgaattcaaagatactttttaaaatatccttgttttggaattaaattataacactaaaactcacttacagtgacttaattctctcttctctagcttatgtagccatatctttgtcatatttcccattaatggaaatatgagatttgttacacaaacaagagcaaaatatgtatttaacttacatcttctatgtccttgtccagagctactattcttaaaggtgaagtcaaattgagactgtccgaaatggttgctcccactggggcagattccaggatatagccttgataactgggcattgtaaaatatggactttgattgttttcatccagtatttcaatgtgtagaccggcaaaggcaggaagaggatgaccattgtcttgttcagcctaaaattgaaaagaaaagaaaatatttagaaagtatatgtcgtgctatctttttggagtttcacttttcatgcaatatatagggttctctttttaactaatatcatcacataaggaaaaaatacgttaaagggccatttgaaaatataaatgaggaaatgaaaatccagtgaggcttaattgcttcagtcttctgttttaaaactcagtgtatattttaaaaattcactgtaataaattattattattttattttatgtttttattttttgagacagagtcttgctctgtcgcccaggctggagtgcagtggagtgaactcggctcactgccagctcttcctcctgagttcacgccattctcctgcctcagcctcccaagtagctgggactacaggcgcccaccaccacgcatggctaatgttttgtatttttagtagagacagggtttcaccgtgttagccaggatgctctcgatctcctgacctcgtgatccgcccgcctcagcctcccaaagtgctgggattacaggcgtgagccaccgcgcccagccaaattattgtaatttttattgaatgcagtaggagaggtaattgtgtttaaatacatttagtcagaaaattcaaatggagatacttgagtgtaccgctgataaaatatttaaataaaagaaaaaaagtaacacaaataaagaactatcgtatcgactttgtctcttctgtgtcttctcattttacactaatgtttaaatctctgctatggtctctgctgttgtaccccccaaattcgtaagttgaaattttaaccccaaaggtgatggtattaagaggtgtggcatttggaaggtgataaggtggtgagggcagagccctcattaatggggtgaatgcccttatagaaaagggtctagagggctccttttccccgcctcccaccacgtgagaacaagtaagaaggtggaaccaccctctgtgaggaagtgggccctcactagaaaccaaatttacaagagtcgaatgtccagcctccacgactgtgagaaataaatgttccttgtttataagccatccagtttatggtgttttgttattgcagctcaaagaaacgtagacaattcccaaataattcgtaattctatataaaattaataaagttatatttattgcccactgaccgtccccaaaagcttcttaaaaaggacagaaataataaatttcattgtaatgttgtagaaactgtgaattgcaatattatttaactagaaatgtttttcaagtaaaattaatattcttatgtataaattttcttttttttctcccattaagtttaagaagttgataaaaatttctgtttctaacacattttcatacaaaatctctacatggtcatgctgcacataggaaaatactaaccatagattttctgttttttaaaaaatatatattttattatatgtgtattggaaggtttaatttaaaggaagatttcatcacaattgacttctggaaaatctcctccaacttttatgagaaaacatggatataatttaatagcatatacatttattaaaatgaattcaaattctatctttaatttttgttatgttttccccattgggagaaaagttgtatttttaaatcaattaaaatgaaaataaaatatttgatattaaactctggtgtgattttctagatagatagtgacagtactttgtaagtagctcagctagagatctctaactgttaaaacgtgaggaaagaaatttggtctccagaagacaatttttcacttccttctaatagtaatttaacattttcatctgttaaaaaggtaggtaacaaactacagtgatattggtagggattgctgacttttcaccaagaaatattacaatatattttccttcatattatttatattgaagatttgttgaaatattatttatgtcaattactaatgtgaaattatgctaattaataaacccatagggaggtaatgtcatataatgcattgattaaaaaacttatatttgatttttaatatattgatatctctatttagataatatgctagattttcttagtaatattacatagtttaccttatgcatttaacttttcatttggcagcagaatgtcaaattagcccatggcacaaaacgctttaagatcctgctcagcactaagaagaacagtactggaataatgtttggtcctgtctgggattatgtatccatctcacataaccaggcatgctgctaataccatcagtatggatgaggtctttctgcatccagcagttgtgattaatttgtgccgagcgatggatgttcttttaggagttacccctgtgacacacatcaggctttctggagacagctgaccagggcaagaggtagagtctacgcctggaaaacattgttttttcactgtttaaaactaattggtccatatgggcttccaacccaatgaccttgaaatgatttaagcaggaatcctctgcttcactcttacaggctcagagcagttcatacatgcaaggcattttgaacagatttttttctctctttcttgtatctctccatctttctttaatatctaattattcttttttttttttttttttttttttgagacaaagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaataaccagcatgtcatatccaggacataaaaatgctatgaaaagtcataaattctacaacttttcctctttccccgatgaacacacccaaacacacacaatatataggtggtgaggaggatgaaaaaagcaaaattgtataataatgaaataagcttacattttacattcagatcatatatcattagtttttaccagcagctgtgaagccagtaaaaatatgtattatttgcatgatgaaaacaaagtgattcaatgaaaagagaaataaaattcaaatcagatctatgaagataatctaattcttaacttcctcatatctataaaaattacatataaaggctctgcccatttttactctaatattaatttagagttaataatgattaatatttttggattgctactatgtattttgttctatttgaggtgtttcaatttgctgaccagatatctgtctccaaagcccactttctttatgccatttatctgtccagatgtgaaaatgtgtatttttgaactgatggaaaaaaagaaaggttagttttatattcaaggccacataggctgtaagttacatacagaacatgggcccagactcaggtctcctgatttttaagaggctacacaggaagattcatcatatgtttctcaaatttacagaatgcaaatgaatatcgaaaagcaagagagatgggacaaattaacagtaggaaaaaatattgagataaatacttctgttaagtaagagttaaaatgttgaatttaaacaacaacaacaacaataataataataataataataataatatactttgctcgttagtgggcccatgcatcaaaactctgatacaattatcttttcttccatacaatataaataagggttctcaaaaatctgaattattctgttcccctgaaatccgtggtggatgaaatgagaaatattttaaaaacacctcagttggaataaggtggtattttaaaaatcatttactttcataaggtaaccttatttatatttacagagtctatagttacgagttaaacattatatttaagtgctaggttttgtttgaaaagcgtctgggcatgagtctcactttcagtaacgagaccaaagtaaaactgaagccaaaaaaaatgaagtataaaaagcacaccattttgttactttggaaggcaaaacattgaaaaagacaaaccactccatcttcaatattgaaaaaaggaaatactgataatttctgagcaccttgtaacggaggactgagactacagaataactttgttcttcctaactggtggcaaacaatttaacaatttcataatctctaatatgaaacctttcaagtagattcaacaatttaaaaaagacaatggtaaagcttatcaaattatttatcatttaaataaattctaggatagaagaaagaaatcatgttttccaggaattatttattgtgcatctacagagcccactttttttttttttttttttttgtattttaaattctgggatacatgtgcagaatgtgcaggtttgttacgtacgcatacacgtcccatggtggtttgctgtgcccatcaaccagtcatctacattaggtatttctcctaatgctatccctccctaggcccccaccctcgacaggccccggtgtgtgatgttcccctccctgtgtccatatgttcttattgctcaactcccacttcttagatcgcaagtgctcaccttcatctgtattcaccctcccaagttttcttaaacccacttcaatcatacttttgcctcagccactcaaagccagctgcttttgtcaaaatcaccggtgccttttacattgctaaaagcaatatttattttcagtccttatcttacttgacctatcttcagcattattcactatcctttcacggcaacagcttctcggttctcttcctattttactacccattttttctcattctcgtttggtggtttccccttttctcccctacttaattttggagtggcccagaagtgaggagttattcatcttttctttatactcactcccttgctcaatctagtctaatctcacaccttaaaaatgtcagtactattatgactcctaatttcaatctccaacctggatttctcctttgaattccacagtccatatccaactgtgtacttcgtaacactgcgtaagtatctaacagacgtttcagatataaatacctgcaacaatgaaattctgattaccctgcacgaacctcctccactcatggtcttttccacttctttaatggcagctacatagttacaggtaccgaaaacaagaaacttggaggcacctcttgcttcagtggatagatatggaaaaagtgaaaaccacttttttgaaaattgaatttgaagttccatcttctcatttcacaatacagtattagcagattatatatgccaagaaatattctatgttagtaaacttgagatgaaaaaatactcttatgtcaatgtagtgaattatggtcttatcctactgaagcattaaaggtaaatattgcaattttcaaagttaaggtaataccacattttaatttggataatattataaatttatgaaatatttttctatatttataatatgtaaaaatagaaatataatcatattgcttgtatagtaaattccactgttctatgctattgtaaacctaaacctttcttgtaattagtctgaatctcatttttcattagatttttaaattccatgagcataaacactgtaaatgtatcagtttcattcactgctaaaatttcggacaatccctggtatatggaagaaggtcaaatatatatttatttttacttttctgtatctttaattttaataggctttaaatatttttttaaaaattaagtgattgtgacatcattctaattcccattcgatagatatttatggatgtttttccagtgtgtgtgtgtgaacgtacacgaagtggaaattaattaatgtgaatgtacaacatgaacaccttagattatagaatgtctttattcacacattttaaaggtttgtgatatctgcaagtttacctatgggtaattaatactgatgcacattcttgccagtcttatgaatgggcctcacccagccccctcaatcatcaattatgattctatatctatagggatggtgctgtgaacagaataacgtataatcttctagaaggtttatgcatttacatgtaatatttatgcaaaaaggcctatttatatgcatttttgaatggacagtggcttaaagaatgagatgttagttgtgactttgctcttaacacatggcttagatacattttattgtcagaatggtgcaaattgaggactttagcatgattttgactgtgtgtactcttccagtccactcaacacattttaatttattaatttaatttacttgctttacttactgaactatagcttttaatacctagttcttagaacctgcttggccaattttcgcaaacattagatatcttaggaagagaaaaaaaaaagagggagggaggaagaaaaagagggaataaaggatggatagagggagtgggtaaggaaaacaaatggcattctcctttcaccagaggtaagggacagataaatgttaaaaatcatggcaaccacacaaggcaatcattctcaaactctgatgtacctaagaatagaatggaaggcctaataaaaagcagattccctgggccaggcgcagtgtctcacgcctgtaatcctaacactttgggaggctgaggcaggtggatcaccagaggtcgggagttcgagaccagcctgaccaatgtagagaaaccctgtgtctactaaaaatacacaattagccgggcatggcgctgcatgcctgtaatgccagctactcgggaggctgaggcagaagaatcgcttgaacccgggaggcagaggttgcagtgagccaagattgcgccactacattccagcctgagcaacaagagcgaaaccccacctcaaaaaaaaaaaaaaaaaaagtagtttcccacaccctatccacaaagattctcgttcatatgttgatgttagaggcaaggaatctccatttttatcaaactgtctgtggtggttataatgtgagcagaatgtactttcacagacattattctgggtgtggctactcaaactccaatttttagagaatctttctttttagccctattggttagggctattggttagccctattggttagtggaccagtctttactaatggatagtccttataatctggagcaaaaactccagataatacagtgcatccaagagccaatgttgtcacgccagaagatttggagtctagtaactgaaactgcatgcaattatacaattatcaactgtgtaggttcaacaccactaaaattgtcatgtgactctagcattaccaaagattgctcgtgtgtcagtgggaatactctacaagtaataagctcagtcttagctagtattcataggtcatggtcaaatcctcttgacattccattattcataattaattagaatttaggtatgttggtgtatgtgtgcacgtatgcctgtgtatacacagtatcaatatagttttgggtgtaagccaccacttttactttatcatttttaaataaaggaacctcagattgagaaaaaaagcagagagaaggtaatttgacatacagaaagtttttggtttctagtcagagtcagagaaagacaaacgcatatagaatgtacccggaaggcagataatgacaacattctgagtaatagtatattcctgttgctagtgactaaacataggatataaggctactatgtaattcaaaattttcttcttcctgtgttcccttcctggacaccacacctcttgctaaacagctcttcagtaaagccttcaatatacaagggtgtaatttttccaagtttcttcacccagcaaggtgcaggctgcatattgatctttatatgaggatgattctgaaaaacgggcaaattgaccgaactaccaatgattcacgcatatccctttattcctttattttcaattttaaattcaactctcaagtagacaaagaagattgtttgctttggttaattttgctggagggctaaattatatatcctgtctttctttatggatagaaattgcatttgcttaacattttaaaaatcactttagacagttaaaatatgtttacttaagctttcaaccaatttattttttggcaataacaatattattagtgtataaccttcaaatagcctgacatttggacatgtttgtcttgggattcaaacgtgaattacttgtacttttattttgaaatcaaaatgttaataaaagtctcagatttttctttagcagacaattcattgccattgaattttttcacaggtggaaagtatatggttgtggaacatatacatcctgagttggttacagtacagaaaaatagaaggaatcataaaactcttaagaatctgattaaaaacatcaacatttaatccaattataaagtgttgcaaaaaaaaaaagagaaaagtaatctatgctgttagaatcctatagtggaagtttgtggttgtgtcaggtggaggtaaggtgattagtgactaggaggaggtgtaggaggcgtatgggatgtttgtagcatctttttttaacaaaaatctggttgttagttacatgattaacttcactctgtgaaaattcatcaagatatacactttcctgtatgtcagcagcatgtcagcatttcaataaaaatgttactaaaaaaataagctatgaacttgctccccaaaaaagtgtacatagactatcccttcctctcctatcacagtaaactaggatacgggcgctcaagtccaagtggtaatttaatagcagctgccctaggaagtgacatggaaaaccaacattatgaagatacgtgaaaattaaagatgctcccctcttcaaccatctgtgttcattaaagatggaccccaaaagtaaacttggccttttgcactttcccactaagtgtttcccaaatactgtggtttccaaagccctgcttcttatctgctgccttaaaataatctaaggtaattgttaaagcaaattcccaggggctcaaccaaaatatctgacatgtatctgctgtattgcttatttgttttctttattagtttaattttatcatatcttcctaagttttcaagtaattttaatatatgacttgctctcaaaatttagcatccgaaaatcacatgtaaatcttgattctgtagggagagccctgaagtctgcctttccaaaacagccacatcccctggtcctggatatgtagaatcagtagtcgtttgggatcagttggatcaggcattttagcttctctcacacaggcttataggtagctgttacactaaaaaagcctagggtgagcagctgaggccaactctgttctagccttttatgtaagtcattatcactcttcttcactttcagcaaagtctcttaatttggacttagttggaaactgaatggaaggaattcatttatgtaagggaattctctgtaggatcctgcagctcactgaagctctacaaaagctataggtccaaagcaacagtaattggtaacaggttatcaggttatatttcctttgtgtgtgtgtgtgtgtgtgtgtgtgtgtgtgtgtaaaatgtcttagggagggatgactgtgaataacctgtgctccatgaatcaatgaacatattatcaactgactaaaaattattaggtttttgccattaaaagtaatggcaaacaccacaattatgtttgcatcatcctaataaaaataagaatatcccattgattcttgaccctacttataaaattaactgccttaaaacctacaggagcctccttttattcaaaatttaatactctaaaaattaaaggatgcatatacagtttgactttaagccaatttattactattactaaacatactcaaaaacttataaataaattcaaaaacctataaaattcatgagataaaatacaaataactgttgtatgctgtaaagtttgtttgcaaggctatacagcaaaagagtatattcttggttggaaacaaatacctttttttgtatgacaaaaaggaaaagaaacttcactagatagaatataggcagcacatattttataaagccttgtaatataacgacgaaataatactgacacatttcacacctagggaatatttttaataaaacgaaatactttctatcttcacttcaagtaagaatatgcccattctgtttataacttgttacaacgaacacatgaatcctcaaagctcttgtatacctttcaatgataaaaatctttctttttgcttagagcatgagatacaaatcgacactggaatgactaaaaggattttgaatgatttaaagaaaaaataaccttgccactctggggaagaccacagattctgaaaactctcacttatcaccgacatgttgaactatttagctggtgtttggaacgtgagaatcatcttgggtataaacagcaaggtcagccagatataaaattctgatagtgataaaggggtaactttttttctgtgaatcttccaacttatgttttatttttattattttatcctgccttttgccttccaaccagcaaagccatcttatcctacactgaggtctgatcccattcccagttttttgtcaaccaagagaaaaccacactaaagtaccttctatgaattagccaaccagaataatgtattttgtaataagcaaattttaaaaaatcattaacataaaaattatatctaaatcgtttatttttcagagcctagaaggtattgagggtgagaggtcaatatttctcctccacctactggaccgttcttgagacaaaaaataacaaagagttttagcctacaagtttttcaatatgctctttcattgttatatttctatggaaccaagaaacctatgaagaacgattactcgggaacatatgtgatagagtgctaaggatgtttatgtgtgtggggattgcagagtggggagacgtgacaagggttcagaaagtgcctttcctttgaacattttacaatgtttggtcttgctcttgtactcttacaatgacctttgcagacaagaaggccttggcaaaaagcaaggtactctgatgagaatggataaattgcctttcttcttcccaagcagttacaggtcaccttgtgaggaagaaaaaaggccaaataaaatgtcacctctgtgtgtcttttgtcagtttgtgctttttgacagccactatattcaactgctacattctatttctgttctaacactgctgcatgaataacgatatgagacaagaggacatcatacttcctttccttttattagcttccataattggcataatagttaattaatttaggccagtacttagaattgttagagacaaaccagtggaaaataaaaacacacggtgttctttctgaagaaacacaaatactgttttgttttgtgtgtgtgtgtatgtgtgtgtgtgtgtgtgtgtgtgtgtgtgttttggtattatttattatttcctagtaatggtagtgttgctcttcggcaatatttttgctttgattaaacttaactcattaaaacaaaagttgtaaaaggtaaagtttttagactgacttctttttgagcttctacatcctctgtgatgtatctcagtatgttatctgagtcaaattgttgctgttctcatgatgtgttgttggatatggtatcaggcaccctgtggaggaactctctggtgggaggtggtgtacaacgtcacactgtagcagaaaacctgaaggatactcttagctgccttctctggcatttgatcccttagttctatccaagtgtatcactttatccttaggcagattaaatttcatattatacctctgagctcatttacttactctgttacacttaaggtaaaacagatatagtcatttgtcttaaccattccctcttatttagtgatatgttcaaatttcctaacataaaggcttttcttcatcattaattagaagcattagtgatcttatatagagagtctcgtggaatatagttttctcccaaattcttcttggccctccatttttaagccagttgataacatccccttttgttagttggatgctatgacatatcatgacaaaaattatgctttgtgtggcaatctgctaagtttaaaaaaaaggagaacacaaaattaaaatacgaacacttagtgtatcaaaggtcaattgatttcagaaattgtaatatttgttggaaattcatggaaagattgctatttcattactaataacaagtaatgcctgaaatttctgtggggtgattttctctaaaatgtgtaagagatatttactttgccttaccttagagacctggctattggggtagaaaagataaacttattatattatttagtaacctactgaactgaggtgtggtgtgcaatggacttaatatttgtatctctccaaattcatatgttgaaatcctaatccacaatgtaatgcaattaggagaggtaattaagtcatgagaatagaggtctcataaaagtagttagtgtccttacaaaaggtaccccagaaagctctctcaccctctcaccctctcatcctctcatcctctttccaccaagtgaagatacaaacagaatttggcaatctgcaacccagaaaaggaacctaactagaacccgaccatattgagtatgaaattccagcctccggaagagtgagaaatatatttctgttgtttataatccacccagtcttttgtactttgttagagtggcctgaactgactagtacgtgtctgtgtgtgtgtgcgtgtgcgtgtgcatgtgtgtttgtgtgtgtttcattcttgccataagaataagagtaggaatatattgctagaatatttccagatatagaagatatgtcatttgtagcatttgtcttccttcttgtagcttggcaatagcagccctgatgttttttctcttgtcctaactctgggtcactatggaccctgttcaacctcaccttaaaggagtgccaatcgtttccatctcttgtctttttttttcctctctctctctcttttgtttgaaaactgatgatatacacattagagtagaaagaatataacttatatttcacatctccataacagatttaattaattttattagctttttcattttcacggtaggttccatctttttcattttgagaagtgatgactgatgatctttgacttgctactctgcctgacttagacacctgtgatctttcaacttgacaacatctctgtgggaaattcaggtagggggcaaattgtaaattggcttgaaggcaacatgcagcagcatgatctattttttgttgttttagcgatactctgttggcagtgtgaaaagatggacaagatgcacagaaatgaagcatgattttagagactgcttgtgtaagatcatgggccaagagaatgcgaaataaagaattgcagtagatgagcagagttgagatattcaagaggatttcaaaggtatcaggaagggattctatgagtgactgagtgggaacatacgagagaagagacctttgaggaagtggaagtgtctagcttgagtgggtgaccaactaaaatatgattaactgaaaaagggaatagaaaatagaaggtttggaatttttaaaggatgtatatagtttgctatatttttaatttgtcacaattaaataatactaggagtagttatccaaccaataattgaaaagatgtccgtaggcatcagaagtaaaatatgtctcctcagaccaagaaaaatgccaggcacctgagaagcattcaacaaggattagggaaattgaaaactagcaaatgtcatatgctttaaaatcattgaatcagggtgttctcttaaatttctatgaagtaaaatatgatttttatcattactcaaatagtgactaaacattttctagagttatgacattagtgattcatgtagggacaggggttgtagtagctgtcctcctcttagccctcaatcatttctcaaatgctgttttcctgtaactctcaaattactgaaggatgacaccttgccagggcatcaggcacatcagcactaagaatcaagctcactagttttaattccctggctaattttctatggcaaatatgtaatttttctttagaagaaacacattttttgacgcagtcataagtagctttagttgtgccataacaaaggtgtgacattttttctaggcattgaatttatgtggaaatctatttgctacatttgcatcttttttttttctggacagagatgcaagatcaaattgtatcaaatgcacacacattcacatgtaagtatttagatagagtgaagacgtaggtacacagattcagcagtctgaaaagatttactgtgccagggagaaaataattacaacaaatgtttattaagcagcttctatgtgctgtatataggtaggtgtaggggcatgggatgcagtgtaaataaatgttttgcaatctgccctcctgtaaaagttgggagaaaataaacaggtacattcaatagagtaattggggccactttaggggccaaaaggctgcaaaaaagcagcttcctaacagtggctatgcctttcgagggcaaatgtcttcttagttaaaaactgaaacatcagtttgaattagactgttgacaagaagagggaggaatgattcaggaagagggagagtatctctaaatgcttagatgtcagaaagagcatggtcagttgagggcactggaagcggtttagtatgtttggaacagagggtgtgcaagttaactagtgagagctcagggttagtgagctcatgagttggaaggaaaagaagttaaaaggcagcatgctagatagaataagtaggtcagtgagtaacaacatgaaaatcagaggaaacatgaaacaattatgcttctaatttcattgtgatctttgctcttcgttgttaattaaagggatttagattaaaacatgcaattgttatttgaagaactgagagacagtaaattattcaaaatttatccatttaattggccttaataattaatgactagtagctttgtattagatgcctgaagtataaatatatcaactaataatacttgaaaatatttcacttacaatactgaaagtgattttatggactttgtaatagatggtccacacgtgaactaattcactcttaccagagttcttaaatgtgctttcatatttttacatcacaggtggtttttattttatgagtgtagtgatcaaataacttatccaaactgggacatttaaaagagcaacagaggtattatgaataattacacaaagacaatggacataaacatgtactgccctgggtaaaccaaatctatgattcttgttcacagtgtatatcacattttaaagtatgcttaaatgattacaattatataaaatttaggatagtgttttggaatggaacaaactttttcaactgcatgttttaatcttttcatagtctaaagtttgtgaactattccattttgtcttccaagttacacctttacatttttatttgtcagcatgctgaataaatcactgggagaaaaagagaaaaaaatgaacatgagaaatctctaatttgtggcactcaccagctgttaaatacacacatagctttttaaagcagaattcttcttcaaaatgtaggagaagagacttcattttattttttctccgcttttgaaacataaattgggatctagtccaacaaaaacttttagggccaatgaaaaaatgaagtattattaaagtaaaaagagagagagagagaagaaattgaaagatttactatagaggagaactgccagattgtagcatttcaatggtcccctgaacaatgccacaatactcagttattattcaagcaggtggcacattattattacagttagatacctttgcttattatgcccttgacttcacacaaaacatagtaatttgaatctaatattgtctgttaaaacttccattaataaaagaaagtgctattaaaacaaaaaaaaaatctgtggcctattgtaattgattttttttctgtaattgatggactgagttacactgtacccaggtacaccaggacagctgaattcgataataaaggaaaataattgatttttggtttcacatgtgacagtttggaaacagtgctttgtcaaatttcttaattcccatagaaagcagcaccacaagagtcaggtagatccacaatagaaaatcagtacacattgtggagttttatatactctcataataattaacataaaatagtcaatgtaagaaggtgaatctcatgcatggccatttaatacaactggttaaagtggtgttttttgttgaataactcccaaacccttaataaatgaaatcccaggaaactgtagtcatccttcaggctctctccgtggtctgacgctatacctcatttccctgttaactgcttgtagcctgtgcattatgtctccaagcgtttacttctgtgcctccttatgttcaaacatcatttcccacttttattcattgaccatactctttcaatccagcaacatttagcttggggtgatctccagaaaatcttccctgagtttccagattaatttaaatgtccctattctgtgtgtcgttaccgctttttacacgtcttcctcttagcatttgatgcattttatctgatttatttgattatatgactgtttccctttctagactataagttttttcaaggacaaagatcgctgaataaacacaggttctgtgctaaggacatatctattaattgttaaactagacaaccatttctaagtatctgcatatttgtgaagtgaaaagagcatggctttagcgtatataaaactaaatttgaatctcaactctgccccttattagtaatgtaactctaaggtaatcacttaccttatccgaactttagtttccccattttgtgcaaatgagaatattactaaaattgcggcaacagttcaatgaaaaatgcacacaaagcagcttaaacaatgttcattctcagtaagcttccctaccttacttccttttcctttagtatgtttacatttttcaaaaggtaagaaaaataccatcgggatgcatttctagaggttttttttgcatgcttaaatatgagagagttatgtactatatacaaaacttatgctgaatctttgcttttgtcttttcttgtacttacaatgcccttttcccagtcccatctctgcctggcaaattcctgtttttccttcactgcttagattaaatctcaccatctcaatgaagtccatcgaaattaattagaagaatatctgcattttttcagtatctatttaatgattatattaaaatatagatatactattaaaccaaaagtgaaatgccaaatagattagcttagctttgaattatttcaagtctaagatcatctttcaatataaagaaaataatgagacatatattgaaagcatctttggataggcaagacctcttatttttatgttggaaaaatcattaaaaatacattagaatacaattaagtaataaaaatgaaaacaaaattaaaacaacatataaatcaagcacattttagatgtcttaattggtcatgtttttgtggtaaaacgctaattccttttagtagaaaaataatgttagaagacataatgaattgtgtagaattgtatacgcttgaccaaggcatttgttacatataagaatatttagtattttaccccatagtactataaaacgttattttagagaaaagcaatgccatgtattaaaagtgggcttcgcttattttctttttaacaaaaaattgactgactgctgtccacattaattttaattttataacataaaactgcctacagtagcgtctacagatttatctgattagcagttcataaacacaaggaaataagatattagcttaatttaccttaataaccaaatcaaatttctggtgaaagtctctgtttactggctccaggagactaagttctgctgtcctaggatgcatatggaaaaatcgtgggtaatcctcaggagtccctggaagacattgagatttcagtacataattgagaacaataagtaatatgtgtatctgctttttctatttcccttcatcagctgaggaacaaagctacaatttcattagtaaattaagtttcacaattatgcagttcagggaaagcagacacaaatgtggtatatagttattaataattagcatatcagtaagaaaatggaaaatgtttggatgatttttgaaattttttttattaagagggctctaattaatttgaatcttcatcacatgaaaatagacattaagtggagggagagtaaattttttattatgaaattttattttaatggtgcataaatcttaattataactgtttggtctttcaacatatattgtaataaatgattagtaatttgtaccaaatagtgagatgcttggaaattaatgtgaacatattttgttgcatatattatttcttaagattaatatcaagctaataatgttaatcatagtaaattaaatataggttctgatgatactcttaatgtctacacagggtatttatttatgtatttatttttgagatagagccctgctgtgtcacccaggctggagtgcagtggcttgatctctgctgactgaatcctctgccttcccggttcaagtggttcccctgcctcagcccccaaatagctgggattataggcgtgtgccaccatgcctggctattttttgtatttttagtaaagaaagggatttgccatgttggccaggctggtcttgaactcccgacatctggtgatacacccacctcagcttcccaaagtgctagaattacaggtgtgagccaccacgcctagccaagatggtatttcttaatgtattttaataatcaatatacatttcttcatgaagaaatgtcttctaattgtataatcttcctttgtgtactgcaacattcttttcccaaaatgaagaagtcaaatcataaaattgtatagtatatacatttgtaaaattaataaccataagagaaaaataatatagcttcctattatggaaacctactctgtgctaaatgctttatataactaatcatcaataactaaatcatttacattttacagatcatgacttgggagactggggagattaaatgacttatttaagttaaagggacaatctgaaacagagcttttattaaaaatccaggctgccagatgttaaaacacatccaaaaaggggcttattgttactacttattttcctcaactctgagacaagaagggaaattctactgggcagtaaatgagggggaaaaaaaacagaaacatatttcacaccattaaaaccgactgtaaaatctacaaatagtcaaaattatagatgaaatgcaatatatgataaagaagttatccctcctaataggagagtcatacagaaaatcatagagtttcatacattcttcatggaatatacatgagcaaaccccaaatgaagaagatattcataataataaaaaaatgagcactagtcatagatgaaaatgtggataaattttactctaatgtgagagtgagcaaacctttcctaactatggctcaaagtcaagaagtcaggaagaaaaagagataagtttaactatattgcaaaattgcatggtgagacacaatgaacaaagtaaaaccacaagtgacaaactgagaaaacatttgaaatttatgtcgagacggccgggcgcggtggctcacgcctgtaatcccggcactttgggaggccgagacgggcggatcacgaggtcaggagatccagaccatcttgcctgacacagtgaaagcccgcctctactaaaaaaaatacaaaaaattagccagcctggtggcgggcgcctgtagtcccagctacttgggaggctgaggcaggaaaatggcgtgaacccgggaggcggagcttgcagtgagctgagatcgtaccactgcactacagcctgggctacagagtgagactccgtctcagaaaaaaaaaaaaaaaaaaaaaaaagagaaatttatgtccagacaaaatgttcatatcccgaatatatatatataggtttataaattagctaaaaatagggccagtgagggatttaaaaagtgtggggctggctcggcgcagtggctcacgtctgtaatcctagcactttgggaggctgaggtgggcagatcatctgaggttaggagttcgagaccagcctggccaacatggtgaaaacctgtccctactaaaaatacaaaaattagctgggcgtgatggcgcacgcctgtaatcccagctactcgggaggctgagaaaggagaatcacttgaacccgggagacatggaggttgcgtgagctgagattgtgccactgcactccagcctgtgcgacagagccaaactccgtcacaaaacaaaacaaaatgttcggggctagagaaaaaactgttcacagaaagagaaaggcaaatgactctagatcataagcaaagataagcaaagatgcttatctcgatacataagaagaaaactacaaattattcctacattaagatttcattagtcacttagattagcagttgtcccagttggagactgtactctgttggcgagcctgcaggaaaacagacactttggacactggtggtgttaatacaagtgttgtaaaatttatgaaggagagtatgacataagctaccaaaataatattaatgtttactttttgacccatacatcccacatctggacattttcccatttataataacggaagataaatgaccacctaaatatacatcaatagtggtctgggtaaataaatggtgatacatcctaaagcagatgataattcaaatgtaatgataaatgatagatatctttagctattactatggagttattttcagctatattaagtaaaaaaaagcaatttggaaacaagggcctataatatgctaacctttaagaagaatacacatgcatatttacaaaggaatacatacacacatttaaaaatcgaagatagactgtaacataaaaaattgttacttatgagaaagagagggaacacgtggagaggataaacactgaaactaaatttcattacccatatcaagttttttacattttagagctacatatgttatatattattataaaactaattaaattcaaggacttctctaaaaataaaataaaataattcaatctaaatgtatatttagttgttggcacaagcacaaacaaaaagaactaccccaggtgaattttaaaagtagtactgacatcacacccacagtgtaatataggtgaagtaccagagaaattacaaaactcaaaaagttaagctatctacagtaatcatattggtggtatgttgtgattccaagatagttataggagtattttacaataaataagcacattattatgtgtcattctgattctattcttttcagtattgaaagctggattcttggcaggggatgataaagagatagaaattaaaaattaaagaggtaaaatagaacacctatggttttgattttgaattggcagtggaagtttaaactcaggttgtagtttatcttaagaaacaaaatgcatacaacacagctctgaatgctgaaacacagaactatatataatggccaatatagaagcgatgaatatttctaatgttcagactatggttttgaaatactatttaccaataaaagcacttaagatttctgagagagagagctgatttcaggtccagggcagaaaatcaacaaatagctgtgaaacatctgctcacactaagtagcaagaaagaattccgagactactaaactgatttgaaaagttttcaagagccaaaaggcttttttttgtttttttgttttttaagctaaagataagacaatttgagcatcaataaggatcatatcagtaatgatttgaaacagatcaaatatgtttaaattcataagtttacgagtgttgcaaaataacgtattgatcacttttggagcatgctagagaaatattttgtaaattagaaaataagaaaacagagcatgctttttccatatgagcttaacatggggtaaacaaataattgattaaaaagtgtctcattaagaaactatttcagctaataatttaagaagagtaatagtatcagagtgccatcattttacaacccctcataaatgaatggatcatggcattgagcactaaatgctgctaatatcacaaaaaaagagataaagccacatacataccactcaatagaagaattaattcaacatcatctgctatggcctgagttgtccccctcaccattaacaattttatgttgaagcccttactcccaatgtgaccattatagagagatagacccttttaagaaggtaatcagattaaatgagtctatatgggtgggctcttaaatctgatgggactggtgttctctttgtctctctttctttctatctcttccctctctctctgtccaagggcacacagaggaaaggccatgtgaagacacaagaaagcagctggagaagcttcatcaaataccaaccatgaaagcaccttgatctcaggcctccagaactgtgagaaaacacctttctgttgcttaagctactcagtctagggtgtttcttaatggtagtgcaagcagactattataccacctatgaaacagttttgagaaaacccaacaaagaaacaaacaaaatatgttatttgattaagtgtcaaaatttataggaaacatgggacagagtaacatgtaaaattaaaccaaggaaagtacaatcaagatgacgagaaactctataatataaacaacttgacttctcaataaatgaatcacaagaaaacaatttaaaaataaatggaaagagaaccactgtagattaaaagagacttagggctgggcgcagtggctcacgcctgtaatcccagcactttgggaggccgaggcgggaggatcacaaggtcaggagatcgagaccatcctggctaacatggtgaaaccctgtctctactaaaaaaaaaaaaaaaaaacaaaaaaaaaacaaaaaattagccgggcgtggtggtgggcacctgtagtcccagctactggggaggttgaggcaggagaatggcgtgaaccaaggaggctgagcttgcagtgagctgagattgtgccactgcactccagcctgggtgacagagcgagactttgtctcaaaaaaaaaaaaaaaaaaaaggagacttaggagaggctgggcgtggtggctcatgcctgtaatctcagcactctgggaggccgagacgggcagatcaccaggtcaggagatcgagaccatcctggctaacacggtgacaccccatctctactaaaaatacaaaaaaaaattagccaggcttggtggcgggtgactgtagtcccagctactcgggaggctgaggcaggagaatggtgcgaacctgggaggtggagcttgcagtgagccaagatcccgccactgcactccagcttgggtaacagaacaagactccatctcaaaaaaaaaaaaaaaaaaaaaaaagagacttaggagaattatcaatcccaacgtgtgaacttacatgaattctggtccccttgcatctctccctttccgagaaaaacaaaaacaaaaaaacagaaaagaaactaaaaaacaaaaataatatttgtgagaaagtgaaaataaacactgactgatatttaatattaaataaggattgttatactttttatttgtgctatgatattgtcagaatgctctaaaaatagttattttataagcataaattcaaatatttgtggattaaaattatatattttttcaaaataatgaggaaaaaaattgatagacatatatattttaataagtttggccaagtcttcataattcttgaaactaagtgatgccaaatggtgattttatttactatctcttattttatatatttttaaataagagttttcaaaaatgcaatataatttatcatttgctttggtttgcttttaccctagctttcatcagcatagaatggagcagggctcctggaagaatgaacccaaaatggtgaagataattgaataatagccgctgagctgggaaagattttcatttcccagagagtaatacttactagctgttaactagttactacggtgaaaatgttataatctctttatttgtaaatgatctatctcatctaagtttcaaaacaatcttatgggaaagatatttattgcttgatctgtgaagaaaccaacactcacagaagttaagtaaaatattctgaactctcacggctagtaaatgactaggtcagaagtcaaggtatctaaattcagagtgtaaactctttcctgttatgctatatagcctgagttcagtgaattagacactttggcttcatcggccatctgtttctggaaggttggtttttagacatccttacagaatatcaactcaacaagagtataactagcaattaaaaaatacatctccttagcactttgggaggccgagacgggcggatcacgaggtcaggagatcgagaccatcctggctaacacggtgaaaccccgtctctactaaaaatacaaaaaattagccgggcgtggtggcgggcgcctgtagtcctagctactccggaggctgacgcaggagaatggagtgaacccaggaggcggagcttgcagtgagccgagatcgcgccactgcactccagcctgggcgacagagcgagactccgtctcaaaataaataaataaataaataaataaataaataaataaataaataagtaaaataaatacatctccttggacaaagagtaaaaccaagtgaaatttatttccctgcatttcttaaaagtgtaatgcttttccagcgaggactaagaacacttaatgtttgtgctttcattatacacaatgtttacagtcaacctaaagctgttctttagaaacaaaaaattagccgggcgaggttgtgggcacctgtagtcccacctactggggaggttctttagaaacagctttgattgcctaaatttagatgtaaaattgataactatgtttattatcacaattataaataatacggtgaatttcagcattataattattagagccaacataattagtggttgccaaaacatttattttaatttttatatatgctaagaaaattctacgtttttcactttttcagtattatagaggaaatggcaacctaaattaatcccttggtgaaaagtttacaattttgaagattacgggttttctgtaggataaagaaaaaatgctacacaattatcttcatatatttaaaatgtagaattttaattacacgtgttgatcaagatagtatcaccatgactaagatagtaagcctatccataattgccagaaatttccttatgacaatgtctcctttctctccccattcatatttctcaccctatgcaaacactgatcactttctgtctgtcagcataataggaatgggatcatttatatagtatgtattcttttttttttttttaattttgagaaagagttttgctcttttttctagtctggagtgcaatggtgctgtcttggctcactccaacttctgcctcctgagttgaagcaattctcccgcctcaacccccagagtagctgggattacaggtgcccaccaccacgcccagctaatttttgtatttgtagtagagacggggtttcaccatgttggccaggctggtttcgaactcctgccctcaggtgatccactggcctcggcctcccaatgtgctgggattacaggcatgagccaccctgcctggccttacagtatatattcttttcgtaggtgtgtctggcttctttcaattagcataatgattttgaagtccatgttgtttcatttatcaatagtttatttatttctattgcctaggtgttattctattgtatggatatgctacaactcatttatctattcatacattgatgaacacttgagttgcctccagccacaaataaagatgctatgaactttcctgtatacctctctgaatgaatctatgctttcatttatcttgagcaaatatctaggagtggaatggctaggccatatgatatgtctatgtctaaatgttttattaagaatttttgggcagggaacaagtctgttaattttcagttacgtataggtttgtgtagtcaataccacaatcgggatatagaatggttttatgatcaaataactactttgtgttttccttccccaaagttaaatctttagcaatgactgatttgttcatcaccaccgtactttcatctttttgagaatgacatttagatggaattgtgtagtataaagatttggagactggcttctttcaactcagtataaagcattagagattcctccaagttgctgtgtatcaataatattatattttcattgttgagtaatgtttaacttttaaagaaattgccaaattatttttccaatgtgtctgtaccattttacattcttaccagcaatgtatgagcatttcagatcttccacattttcaccaacacttgatattgtcagtcatttaaattttggccattctggtgtgtatgtagtgatattcattgaggtattaatttgcatttcccaattagctaatgacattgagcaacttttcatattcttattttgtttataaatctgtaataatttgttaaaactttctgccattttataattgtctcatttttattaaattgtgttttcatatattccccaaacaagtcacttgttggatacatttcgcaaatacattctccttttctgtcagttctttttcagtctattgtcagtgccttttgaaaagcaaatgcgtttttactttgatgaagtcaaattttaaattttttcttttatagatttgcatttgttacatttaagaaattgttgccagccgggcacagtggctcacgcctgttatcccagcactttcgaaggctgaggtggggggatcacctgaggtcgggagtttgaaaccagcctgaccaacatggagaaaccccgtctctactaaaaatagagaatcagccaggcatggtggcacttgcctgtaatctaggtactcgagaggctgagggaggagaattgcttgaatctgggaggtggaggttgtggtgagccgagattgtgccgttgcactccagcctgggcaacaaaactacgtctcaaaaaaaaaaaaaaaaaaaagagaaattgttgccaaccctaaggtcataaaaatctttaccaatattatcttttagatgctttatagttttagctcttacattatgtatagaaagtctttcaagttggtttctatagatagtgtgaggtacggattgaagtttatttgtttacatatggctgtccaattgttctgcaatgttggttgtaaagattaacttttccttcttttaattgtcttttgcttcatattatttttgaagtgtttataccttaacagttttttctcatagctgtatttgcctatcatttattagcataatacttctgattccctacatatagtaaattgaaggaaatgtggatgcctgacctaaactatataattaccacttaatctttcaataatttttatttagagcaaagaatcagaagatggatgtacaatctgtaccacaaaaataatgggcatctagaggaaaggccctctaatccctcatcttgaaattcctgtttctgcttcttaaaatgttattgtttttgacagttccttgaattctggaagaaaacaaagtcctttcaataaatttccttaaacgccaagatgaacttaagttcacctctgtattttttacccaaagaggcccattcaggaaaacatttgtttttaatgcttcatacatttgaaaatgcacatctaatatacttcaaaggagcactacctcaaaaaatacagtatcaaatttttcccttcaccactgaaaatgtttatctttacatataaaattagtaagctgattaacacagaaataaaagagaacactgtcttctgggtgccatgaagatgtgtggtaattcctcagattttgacattgtagatatatagaaattatagtcagtttcaataaaacactgctaatgaaaacacccacaatttcctttggtagaacaaaaacaattataacatgtaacttatctctccaggtaatttttttgtgaaaaccttttaatgaaccatgaatgctggataccctgcagaagccaaggtattgaaatgtaaaaacattgtacgagaatagaaacacatgtctaagttcaaggtccctacagaatcccttatttatcccacttagaaaatgtaatataaactctatttagcaaagcttaattcatctaaaaatatagctgcttctgaaccatctctgaagctctgggttttatttctttttagtcattcccttatttgatcttgggattaattatattaatattccattcctctgacattaaattcacctgctaccccttttacataactaaaattttgttgataattttaaccattattttcatctatgccctaacaacacatttgtttttgtatcaagttatccctaggttcaaacatatattagaaaaattacctctaatttctcattattttcttccattaattttaactttagcactttttcttttcagctaatatgttctcttagtgcattctttgataattctaaatgcaaaaagtaaactacctttgtcctgcttttacagcttccaaaaatcattagttctaaatctgtctcctttgcaaaacttctttttcagctacttgttataaataacgaacttcattttcttatcgaaaatgtttttaataactgtgtaatagccaccaaaataatttaaatccatttttacatattattagggaaaactaaaattcttatcttagtagccaatatctcaacttcaaaaaatctttaccaaagattttattgggttgcttttcctatgcatatttatgacaatgcttctgattgtatagttcaggtatacctacactagaaagaccgagttcttgtcccagatcttctgaatcagaagctctgaaaagggaggtcaagagaatgcactttgaacaatctcactgaattcttgtatcctttaaagtttgaaaaccacctcttcatggtacatgatacgttcatatctgttatttaaacataaaaataattacaaaattcagaaactatgttattactaatagaaccaacattttttctgactacgtagattcaaatccccaagttactttcactagccagttctctacacattttccaagtgattcttccttaccttagaacgtctctctgatgtgttcctttttcatagtcctaatctcttaccttacttagacccttgtcatttcatacttgtaccacggtgatagcctcctaatatcttctgacattccattcccttataatcactgaaggaaactttctaaaacgctacttttattgcccaattatctagacaaaattttatctattgtgtactggggtaacccctaaaatagaattgagaataaaaggtataaatttatttttctttatgattgattcaatttacatatagtgaaatgcacagatcttaagctttaacgttttaggggcatagacccatgctattaccactcctattcaaactttatatttatttttaaataaaataatacaaaagtaaacttagctaatgctttatatactgactgacactgtgtctctgtatgttttagggacaagcaaggaatcttgagggagatgtgacaagtgtacagtgtgaagggataagcagcagtgtattattcagagttctttagagaaacaaaacaaataggctataaggacatattagtactgacagtgagaaagaaagagagagagagagggattgattctgtcaatcaattggctgattgattatgcaaatttgttgttttagtccattttcacactggtgaaaagacatacccaagactgggcaatttacaaaggaaaaaggtttaattggacttacagttccacgtggctggagcctcacactcatggtggaaggcaaggaaaagcacgtcacttcttacatggatggcagcaggcaaagagagagagagcttctgcaggggaactctgctttttaaaaccatcatatctcgtgagattattcactgtcatgagaacagcaacggaaagacttgccaccattattcagttatctcccacatggtccctcccacaacatgtgggaatttaagatgagatctatggccaggcatggtggctcatgcctataatcccagcactttgggaggctgaggcaggcagatcacctgtgtcaggagttcgagaccagcatgcatagcatagtgagatcccatctctaggtgagatttgggtgagacacagccaaaccatatcattctgcacttgacctctcccaaatctcacatcctcacatttcaaaacaattcatgccttctcaatagtcctccaaagtgttaacccatttcagcattaactcaaaagtccacagtccaaagtctcaccagagacaaggcaagttccttccacctatgcatctgtaaaatcaaaagcaggctagttactttctagatagagtggggatacgggcattggataaatacagccattccaaatgggagaaattggccaaaacgaagggtctacaggcccccaagtccaaaatccagcaggaaagtcaaatcttaaagctctgaaatgatctcctttgactccatgtctcacatccaggtcacactgatgtaagtggtgggcttccacagccttggacaactccacccctgttgctttgcagagtgtagccccctcctggctgctttcatgggctggggtcgggtgtctgtagtttttccagaggtactgtgtaagctgttggtggatctaccattctggggtctgtaaaatggtggccctcttctcacagctccactaggtggtgccccagtagggactcagtgtgggggctctgaccccaagtttccctcctgcactgcactagtggaggttcttcatgagatccctgcccctgaagcaaacttctgccttaacatacaaggcatttccacacatcttctgaaatctaggtggagcttcccaaacctcaattcttgacttctgagcactcacaggctcaatactttgtggaagctgctgaagcttggggcttacaccctctgaagcagggcctgagctctatgttggcccctttcagccacagctggagcagctaggacacagggcaacaagtcccaaggctgcacaagcatggggatcctgggcccagcccacagaaccatcttttctccccaggcctccaggctggtggtgggaggggctgtcatgaagacctctgaaatgtcctggagacgtttttcccattatctacaggattaacatacagctcctcgttacttatgcaaatttctgcagccagcttgaatttctcctcaaaaaatgagattttcttttctatcaaattatcaggctgtaaatattctgaacttttatgctctgtttccctaataaaactgaatgcctttaacagcacccaagtcacctcttgaatgcttttgctacttagaaatttcttccaccagataacctcaatcatctctcaagttcaaagttccacaaatatctaaggcaggggcaaaatgctgccagtctttttgctaaaacataacaagagtcacctttgctccagttaccaacaagttcctcatctctatctgagaccacctcagcctggttttcatcattaatatcattatcagcattttggtcaaagccattcggtaagtctctagagagttccaaactttctcgcatcttcctatcttctacagagccctgcaaactgttccaatctctgcctgttacccagttccaaagtcgtttctgcatttttgggtctcttttcagcaacaccccactcctgttaccaatttactgtattagttcattttcacacagctgataaagacataccagagactgggcaattttcaaaagaaaaaggtttaattggacttacagttccacgtggctgaggaagctttacaatcatggtggaaggcaaggaggagcaacccacatcttacatggatggcagcaggcaaagagagaacacttgtgcaggggaactcctctttttaaaaaaaaatcatcagatcttgtgagacttattcactatcacaataacaacacaggaaagacttggccccattattcaattacctcccaccttgtccctcccacaacacataggaattcaaaatgagatttgggtggtgacacagccaagcgatatcatttgttatgaatgctaagagcatctactctctgcaaattagagaaccagaaaaactggtggtgcattttttatcaggtccagaggcctaagaaccaggggagtcattggtataagtctcagaatctgaaagcctgagaactaagcactgtaatgtttgatggcaggagaagatggacgttccagttcaagaagagagaactcatccttcctctgcctttttgttctattcaggccctcaatggactggatgatacctgcccatattggtaagagcagatcttcttcactcagtcttctgattcaaatattagtctctttttgaaacactctcttagacagacccagaaataatgttttaccagctctttctacatgccttaaatcagtcaagctgtcaaataaaattaagcatcacaagcagccttctctcttgtctgtttgctttcaacacattgcagtgacttttagtttacatttggccagttaaagggatctgtattttataatattaattttacaccaaactaatgctcaaaaaaatgaataaatagctgagaaatatctctgcaaataaacctgagattaaaggtaacactaatgatatgtgtagaagtgaacaccaacagagatggaaaaatcccttcccattcctctgctaaaacagcttaatcagtcatgttattaggtcaaaaccgtggagatccaggcagaccggaaataaagtcagactgacaattttgatgtaattaatacaattatttataatgttgacttatatataatacaattaatcattttctatgtgatatatgaacattgaaaatttaatgactgataaaatacatgtataattcttaaatattagagtgtgtactcaaaaatattttttaattcatgggatgaaggatcataaaagttatgtattcattataaaatgtagctatcattaactaaatgatatggttttggctgtgtccccacccaaatctcatcttgaattgtaactcccacagtttctgaatctcatgggaggaagcttgtgggaggtaattgaatcatgaaggcgggtctttcctgtactcttctcgtgaaagtgaataagtctcacaagatctgatggtattaaaagtgggagtttccttcacaagctctcttttcttatattttgccatgtgagacatgccgttcaccttccgccatgattgtgaggccttcctgaacatgtggaactgtaaatccattaaacctctttcttttgtaaattatgtagtctcaggtatgtctttatcagcagcatgaaaacggaataatatactaacatacacacacaatcttgcctaaagttatttatgtcttaaagttcagagctccactttatgaaccctctcatctccttgaattacttgaattagatcaaagatggaaaacattttttgtttcctaacaagtaaaataatctttttttcccctcaccttaaatctgggcaggaattgtccttgctttgaccagtatatgatagtagattatttctactgattcagttctgggatcaggccttcagaagtttgatagctttcacttttgccttcttaaaaggcaggcatacatgcaattaaatggactattttaaataaattctataaagaacattttctttaaaaaataatttccaaaatgtagaagtacattaaaattagaagaagcattctagagaatggtaaggcatgaggaaaaatacaccttgggggatatatttaaggttatataatgtttgaaaaaaccacatgtgctcagctataagtgttcagttataagaacccagttgtgtagcacaaggatcatgaaacaaaagaaaatataaacaaaaaataagaaaacaaaaaaggaaacagaaaaatatggactctctgataactgtgaaatatgaaatacaaaatgaaatatggtaactgtgaaatatgaaatacacaatagaagaaatgttgggcccatgaacattttcatcccttctcaatgtgatatatgcattgaggaagggacaaaaaatgtgtttttctcttcacatttccaatatgagtatactgtatacttggccatgaaagtgctaatacttgataatacctaccacagttaatgaaggttgataaaaaaatttaaaccaaggtttctggctctagtatctccattcttaatcaatgggtgacaccaacattttagttgccagaatattcataatattattataatcatactttgaaaaattagaaaaaatactgttagcaatattatatttatgttttagtatgtaacatatatctcatctatatgatatttaatacatattacttttcacacattagctgctcatataagagtacttaatactacaagctactgttacaagctaaagtcagcagactttcttatattattagaaataaatacacattgtatgatatcattattaatgacagtgctgcaacagagcttgatagctgttaacatttacattaaaaatggtcagacttgataacacaattagaagcagaaatttcagctacatatatgattaaggggtctacagattatgcttttctttcagagaccttcatggcaggtttctccaccataggccttgagacttaggaggaaagaatggttttgtgggccaggaccacggctccactgccctgtgcaacctcaggacactgcttcctgcatccagccattccagctctagccatggctacatggcccccagatatgcctcaggcctctgcttcagagcatgcaagccatagccttggcagcttccatgtgatgttaaacctgtggacacacagagggcaatggttgaggcttggaagcctccacttacatttcaaaggatgtatggaaatgtctggatgtccaggcagaaatctgctgcaggggtggagccctcatggaacacctctaccagggcagtgtggaagggaaatgtgaggtgggagcccccacacagagttcccactggggcactgcctattggagctgtgagaagaaggcaactattctccagaccccagaatggtagatccactgacagcttgcaatgtgcacctggaaaaggcacaagcaccaaacaccagcccatgaaatcagccaatggggctgtactgtgcaaagccacagaggcagaaatacccaaggccttgggagcccaccccctgcatcagtgtggcctggatatgagacatgaagtcaaaggagattattttggagatttaagatttaatgactgccctcctgggttttggacttccatggggactgtagaccctttgctttggctgatttctccttttttggaatgggtgtattcacccaaagcctgtacccccattgtatcttgtaagttttttcaggctcataggcggaagggacttgccttgtctcagatgagattttggactgtggacttctcagttaattctgaaatcagttaagacttggggaactgttgagaaaggatgattgtattttgcaatgtgagaatgacatgagatttcagaggaaccaggggtttcatgatatggtttggatttgtttccccacccaaatctcatgttaaattgtaatctccaatgtaggaggagggacctggtaggaggtcattgaataatggggggaaatttcccccttgctgttctggtgacagtggtgtcagtgagtgagttctcatgagatctggttgtttaaaagtgtgtagtaccaccccttctctctcctgctctggccacgtaagatgcgccaacttccccttcagccatgattgaaagtttcctgaggcttctccagccatgcttcttgtacagcctgtagaactgtgagccacttaaacctatttttatttataaatcacccagtaacaggtagttatttatagcagtgcaagaacagactaacacagaagaggtattaaatattctctaatggtagaatttaccagtaaagcatctgatccagaattcttctttgtgggaagatctttttgattactaagtcagtctattaacttgttaaaagtctaccccaattttttattttttctgaagtcagtttgaatagtttgattccaggaatttgtccattgcatccatttgtctagttggcataaattgtatataatattccctcataacatttttttatttctctaagctaaatagaaggtcctctctttcattccaagttagtaaattgcatcttatctcttttattcctggtcagtctagctagaggtttgttaattttgttgatgatttcaaagaattgattttggcttcatttattatctctactgatttcctaatccctcttttattactttccactgtagtctctattatttctattgtgttgtttagctttctttctttttttttttttttttttttaaagagagtcacctccaatctcctccatcactcaggctggagtaaaatgatgtgatcgtagctcactgcagccctgcagccttgacttcccagacccaggtgattctcccaccttagcctcctgagtagctgaggccacaggtgcacaccactatgcccagctaattcttgtattttttgtagagacagggtttcgccatattgcccaggctggtctcaaactccaggtctcaagcaatccaactgtctcggcctcccaaaatgttggaattacatgtgtgagtcaccacagatggcctcccttctgctctttttctttagtttgcttaacatttccagtgtctttgtgacaaatattacattattgattagagattaaaatacatgttacaaagtattgttatttttatttgtctcaaagtatttttctgattttatttcttccatgagtcattgattaaagaatgtttaacttccatacacttgtgaatttccaaaatttccttcattataatttctaattgcattccatttttgtcagagaatagagtttgtattatttcaatcatcttcaatttaacgatattggttttatggcctaacatgatctatactgaagaacattctaggtgcacttgagaagaatgtgtattctgctgttagggggtagagtgttttgtagatatcttttaggtctagctgctttatggagttgttccatcttgaccttaagttactgcatttgcagagtttcaaggttagtcagagatgagagcttagggccttcccaagtgcttcctgagtatatatacagcttgcttttatctttttagaatcccagaaatatgttaaactttttaaaactccctatgaacatcattatctagcttttcctttaaagacttttggctagtcaataattctgccattgatgttcatgacagtagaaccattgaagaggttgacaacagcccttggatgacctcgtcatagacatcagcatccgtatcctcacatatagtaaacagagactgtctataacaaatggaagcaggagaggagtcgtccatgtggtaatttactgttagcttggagaaacacatatattcagaagtatttgtatggatttagggaaaattaagagttttgacaaagtacgtgaagtcagagtcatggatatccccttctgtgtgtgtgtgtgtgtgtgtgtgtgtgtgtgtgtgtgtgtgtgctgtgtctggtttttgtttttgtgtttccatttgtaccagactgatgtgacttaggtaacatgccttattttccttcctaatgctaataacaatgtcaactaaaatgtattgagcattaactttttttccaggcagcattatgtacatttacaatgtattggatcaaattctcacaacccttttgtacaaagatctatttttgttaatcctatattaaagaagaataatctggtcaggtagtggctcacgcctgtaatcccagaacttagggaggctaaggtgggaggatcgcttgaacccaggaagtcgaagcttcaatgagctatgattgtgccgctgcactccagtgcgggtgacagagcaagacactgtctcaaaagaagaaaataagaaggactaatttcaggtaaaggggggctaaataacttaaataaaattatgtctagtgtgagttaaagtcaggatttttaacatggacagtacaatttccagaggctacactctcaacccctacaattctcttccttctaaaaatgtaaatagtgtaaaaggatattattcatttaccttagctgtgacagcaaataattgtaagagtttatatctattgtttgggacaatccactatcctacggttgtaggctgatgaaactttccatcactgtgtcacttttctgttaaaattttttaattggctcctcatttcactcagagaaaaatacaaagtagataaataacatacaaggctctctagtttctgctctgttcttatctgtcacctttctacttttacctcactcacttctttccagtacttccggcccccttgttgtttctgaaacccacctggcaagcttcagttttgatctctgcctagaactcttcccggagatatcaacgagaataacttcctcagcttctgtaagcctttgctaacagcttaccttttgatgacacaagtgctgatgatactgcttaacactgcaacttctactacaatcctcctctgcttttccaatcccattcatatgatcgatttttcccatagcattcacaactttctaactttgataataaacacttacttattatagtaaatgtttattgcctatctcttctgccagaaaactggctccacaaagtcagtgataggggttgcttcacagggtaggtgatcgtttgttgagaaaaagaatgcacataacttttaaaagtgaaataaacttgaacaccaatgcatccaactggctctgagtatcataattatccaagtctgttattaaatttcatcctttggcttttgcacatgctgcattatctatatagataattgtctctctttttccacctggaaactcctgtctttctgctaaaatgacacttcctaagcaattctcataaaatgcttaatgctctcctctcatgagcctacatgtggttcaaactttatttagagtgccttaaatattgtattttaatttatcttttacgttgttttaatgttttttagccacagactccacgactccctaacctagaacattcatctctcatatttgtgtttttagcatctaataagagtgattgacatacagtcaagccttcagttaatgaaataaatgatgctttattatctacaccaagatctctatagacttaaaatagtttctgtttatgaaagttttttacaaatataaaagtctgagctctgcttatgatatttgtgtctttataaagaccaaaggcttgaaacagaattgcttgaattttctttacagacagcatttctaagaaggatacagtatgatatttgcaaatctaatatctgttggttgttgtgtatttgtatatgcacataggcttcaagtaagaggacagaaaggggttgagggctaatgctgaactccattaaagttatttttcaagcacacttcaaaagaagccctttctcccttaaaagatatatagcctgtctcacatgcatctgtctgtctagaggctatgcaaatcagcaacatccatatttcagcaaaagcaatctaagaagagcagcataatcaatttctcatcatttttgcttttgacacaattagtagtatatgcatagggatggattaggatggtttctgtggaatttttcaagaaaaatatttaccaaaggttaatatttcgtgttcccttgggctaatcgtgctctctcaccttttttttttaaatggctccaaaatagctctttttaaattcagtcatatattatcacaattatgtatagtaaccaaccaaaggtaaaacacgtgtaaaatgtttttcattttatattaaagctgaaagttggtgctagaggaagttttatatgataagttgatatgtagaaaaatactaatatgtaggttaatttcctaatattttgaattgctttgcttcttccataaaagttattcatttatcattctacacatttcagtccaacaaattgaggaagcaaatatcttgaattattatttttaaaatgtgtttatacacaaaagtaacaatcatgtcaaataataaactttgttatttaaaatatttccttggaattgagagaatttgttactgtaagattctagaataactgatagtgtaaaatgttatcagatacaaaccaacaaggatggaatagaggattcctggcctatctgatggcggttgaatattccggtcctgatcaatggcttggattggtggcgtaacaataatggggttcagttcttcctgaaaaaaaaattaagagagtttcattcagccgcattactaatacttcatgaaggattgagacagatgctttagtttggaaatctatataacgtctgagacagtaaactcaagtttcaacatttatgatctaataccttttactagttaattttgaatgttaagggggagcaaagtattctcaaagtcaaaatggtaagacatagtgattatgcacatagacatttatatcagtaactactcctaaaaggaaatcaaggaagaatgataatgcacttttaatcttctctagaggatttcacaaaagaaatagcagcctatcaaatagtttatgaagtaatgttttctctttgctttagacaagatttgtaagaatacttgtattctttccttgctaaatcattttttagtttcatacacatcaattatattaaaatataaataaagtaaataatttcataaaaataaaagtcacattattgcaaatttcatataattaaaattgattttaaatattgcaggtatttacatgtattttacaatggtctataagaaataatgtttaaaattataatatacttctttaatttggtgtttcccaatttaatgtccagtactattttgttgtgctatcaggactggcaaacatttttctgtaaagaaccagataataactatctttaggctttgccaaccatatggtctatgttgcagctaccctcaactctgtcattacagcaccaaagcccaagtgggcatggctctgttgcaataaaacattacaaaaacaggtggtaagttatatgaggttactgactactgtgatcataatagatatgctaaaaatacaacaataggtatgttgaaaaataataaaaagcttatctacacagatatgcttgggaaatatgatattaaatacagttttgaaagccaattaactgtactgcaaatcttttcagacttaattatgctaatctgcatactgactttctaagaaaagggtactatttgctcactttcaagaaacacccattaacctgtttttgaaatgatgcctttagaacacagtttgggaaacactactctaagttatgtagccctcatcccaaatatgtaagtggtaattctaaatgaaatacttctaaagggtaattctaaagggaaattccattacatatttgggctgagggctgtgaaacttaaactactgtttcccaaacatttagtatgtctcaatatctacaaccttacattctaaaaaattactgcaatgttctcatattatttcttctcaaatgacagaacattgaaatatgtaatgtacttttatacaaaaccagtagtttcagttctcagcaaaaatgtatagtgatggcatgctaaaaaaagagcaatgatattaaaacattatgtataatacttgattttatattgaagttataataaggataattattgaccaataatttaaacaccatagacattgtatggggtttctctcgagttcattatcactaataggtcctaagtagtctaaatgttatcagtattttcctgaaaataaagagttgttggtagtagcaacttactaatactctattctctcctttaaacgtggaatcagaaccacgaaaataccaaataaatatcaaaattactccattaaatccagaagattattgttcttaaaacgcaactctcactgaacttttcctcccatgctgcctctctctctctctctctcacacacacacacacacacacacacacacacacacactttcccaataatcaatttgcttggtatgcaatacctgtatttctccctaaactgaaaaaaaaatctgaagttctttgaaatatgtatgtttgagcacaggacttaagagttgacaagctctttctagtaatttcactgaggaatctgattgccatcagccaaagtcagcttatacttaagctgtatcactcctggttcatataattaaatctgcagtaatttttccaaaaccgaggctctatttggatcctgtaaaggcatttcaaatctgaggattttctgcagttccattctgcatctcatagtcagaaaaatattttcctaaacaatttttgctattataaaataagtaatttcttatctagaaattaaaataaaattgaatcttagcttttcgtttggaatgtaaaatgtaagcaaatcacaatatttgaggatatgttggctgatcaccttcatctatttatttctatagatttgctaagttacctacacataagcagttttagctttaattagtaatgtagtataaaatattctttctataatatatagaattgttgaaatgagcaacataatttatttacattgaattgttgtataagcaatgtaaaaactaaaagtaacacatcaaacaaaaccaagaggaagggagaaatgaaaattaaattcctcatcttacacatttgcctgtgattaaatatatatatatatatatagagtaagaactgaagaactaaaaagaaacaagtgtagtatttagaattatattaataattagaagatgaaaaactgtgagtatctcaggatactgagcatggaagtgagggtagatgggatagaaaatattttacataaagccatttggtactgtgtgactatgtcattaccatagcccgtactatttgttttaacattattaataaataaattatagtattgagaataaaagaaaataaactctcttgataaaggctttcacaagtttctgcaaatttaaaagaaatggtgtggtttaaataacttatcagaattgacattttatcttgtcctatagagactagcaacttattttacaatatttatttttccttctgctaccataaatgaaattgtcagataatctaggattaaaggtgaaaagaatgatttcttaactattatgtgtatgattacctctcaagtaaactgtgctccatgaagcttgaaatgtttaaatattattaatacatgacattaaagaatactaaaaattatgatttttaggatgaccttgttaaatatttaacatattttataaagatatgtagcattgaagtcagaggcagacaatttatatacattaattagaagaaacaacataaataacatgcattatgtttgaacttctgtctgccaacacaacctccacagtagatgaaaccaggcctggaaagggtattcatataagcaagaacaacccagattgaaatggttccttagaataagtgagaattttacagagagaacagaagtaaaataataataataatatgtacgtattcagttcaagtatttttttttaacaacagggtaaatccaaagaaaactgagtaaaaataaaatgaaaaaggaaaaaaaaaagtagtatatagtagtaaagtatccaatgctgatgaacaaaggaaacagataaaagaaatagtctttgattaccaagtgccagcatattactgtccttgaatttattgaaaaatagtatccttataatgaacctctttttccctaagttagtttcaggtcagttctctgactttaaacctagagtaccaatctaataaagggctaaagataagagaataacagatggtgtgttggctctcttagagacatttacttaaacttctaaattctgttatttattttcttttgctttttttttttttttttttttttgagacagagtatcgctctgttgcccaggctggagtgcagtggcgcgatcccggctcactgcaagctccgcctcccgggttcacgccattctcctgcctcagcctcccgagtagctgggactacaggcgcccgccaccacgcccggctaatattttgtatttttaggagagacggggtttcaccgtgttggccaggatggtctggatctcttgacctcgtgattcacccgccttggcctcccaaagtgctgggattacaggagtgagccaccgcgcctggccaattctgttattttcattgaacacagttacagctctatgaagagaacagaattattcttgcccatgaattgaaataatgtaatcatttacaggatttagcaaatagcagatatttaacataattttgccaacttattctgttgagttatccaaagagatcactactctctggtcaactttgtaatatccactagcagaaaatagtccatctgtggctactgccaggtcttccacagttccaaaaaggagattgattcagtgacttgtttcttctgaagaacagagtctcttcacatagacaataattgctgttgcttattctctgtcgtcctcatttctcctagtttttgactttactgcctatattacagaggaagtacggtatgtgttgaagaaattagaagtccacccatagctcaaatatgcttgggtatcctttatggaaagtatcaaaatgttcctctattttattacaattgctatatttatctttttgccaaaagctttattggtctgtgggcagaaattatcttatttgtacttacaaccctcagcctagtgcctcacagatttcaacaaatttttgttatcaagtcaagaaacacagaaagagctccccaaaccctggatggttcttttatactttgcctctgaagcaaagctgctttctttgctgtctcatttgtcttcaagaagaggtcatgtctcctgaattctgttccagttgataagcatatattagaagcacacaggatagcagatttgcatttcattgctgtttgaactgtcagagctacattccctgtcttagtcatggggacacataagtaaagtgaattaggtccatataaagagattcataatgagaaggtaatcatagaaacgattaaacaataacaaaaaaagtcttctgtgaaaatactgtgtaattatatggtttaagaaccttaaaattattattttaattttaagaaccttaaaattattctattttgaatacatgcttcctattcattagcttttctggagacacaccttctcttttgagcaatgttaagacaatgttttcatgcagaactgttgtattattctgagaggataacagtagccaattaacatttgatgtgagtgagggttaattatgcctcatgaaacctcactaccagattgaaaatgaacttttggtctgaattctatttttatatatatatatatatatatatatatatatatatatatatatatatatatatatatacacacacacacatacatacatacacataatcattaataaaaatatattagcaagcaatcccaaaagattaagaagcctttttgtagatttaataaaatctcagctttctggtcatttaggtgttcatatggttatcttgaacaaaaggtatattcaagagaaacactcagatttcagagattggatacattcactgtttagcttatatcaggttaacagaagtcatgatccatagaacaataagatttaacctattatatcatccctaatgttaaatgcatacatgatgcctatgattttcactgtttcatgcatgggtaggttgtctttaaaataatatgaaaccagttcttacttttaaaatacttctcacttcaccaatgaaaaataatatctatcatttacacaagttgatgggtcagtaaacttaaaaaaatgacatttcgcagactgattattaaagcttccagccttggttgagatagacataatagaagcattgttaaaatactaaatattctcaacttggcatttgaatgatgtcttcatctgagtaacgtatacatagtagtatactgaatgtgcccaagtatttcaaattaactgaaggcattataattatcttcaagaaagaatatgttctgatacatccctggaaaggtaatctgagctcatataagtacacagtttgctgttataaaagccaaactttgatgtattatataatattccacttatcattgcttagatctttacactgtattttaatcaagtaataacatcatagtatttggagaaaggttatgctaaaatagtaaaaatatgctgtaagtattccaagaccaataattaagtgatttgaaatcttagtaactatataatttaatacctaagttattgaatttattatttagtacttaattactttcactaattttgtgtgttctttacatttaagtaggtgctttttcaatatctattaaagtcattaatatttaatttgtacacttcctttaacaacagaaaatttctactacatttaaggaaagtcagtgtcacgcctgtaatcccagcactttgggaggccaaggcgggcagatcacgaggtcagggatcgagatcatcctggctaacacggtgaaaccccttctgtactaaaaatacaaaaattagtggggcatggtggcgggcgcctgtagtcacagctactagggaggcataggcaggagaatggcgtgaacctgggaggcggagcttgcagtgagcagagtttgtgccactgcactccagtctgggcgacagagcaagactcagcgtcaaaaaaaaaagttagtgaacattattagtctcatttcatattacattgcaaatgtactattttcctcaaagctcttgattattttcagccagattcttgcttgtttccatgtgttactaacatagagaattagaacaaatcaaaaattttctcaaacacattcatatagacataaatacaattatatgttacctttagaggccaaacaaccatttctgttttcactttgcttagttttgcttttttcaagggtcagaaatatcagattgtttgaaaaagtatcagacatatcgaaatgtttttcctggtgagattattttaaaaaatagtaacgaattggggtgagtagtatgggccaagccaattactttgaactttttgtattgttatggaagaaacacaggttgaacattcacaaacctctttgaaactgattcactgcatatatcaaagttcctcaaatggttttgacaattattatccttagaacagaagagtgaagagcacatttgagataggtatataattatgattcatgaaaatcataacaattcatgcctgatcactggaatttcgtatcacatattaaaacaaaaactcacttagctaacagaaaatacccttgttttattatttccatgagcaaattttatgacccctccaatatcatactctttattctaccaagtatgtgtaaatttaccttgtataatgtgactgaatttgtttccaaaatgtgcatttcagtatcctctcaattgcatatttgaatacttttactgatacttcccttattttcaaaatacttccttgaatgtctttgtctttaaagtttgtttacctgggattatatgcctccttttctatggatcatcaaatgatttctagacaggcaataaaaaccttggctggtggtaacccggtaattattttccatgaataaataataaaagcctgtaacaaaatcttgttggtaacaaaaggttggtgacttgttccacgctgtccaagtgacaaagtctgaagcattactgcaatcaagttggctttgactatcaaaaatcgttttccacataactcaaacctgagaatatgcatttcacagatgttgtaaggaggatacatagatcacagaaatatttcttacaaccctttctcacattcttatccatttctataacaactattctggttcctacttctcacactgccacagggctaactcaaaatcttctggttattcacctccccttcattcccatcgtgcacatcaaaaatcctccaaacgattttgacaagcatgacccactctggaagtcagaggaaaggaagaaattgagcagacagagtttgctttaccatgaagataaggagacaatcttgggagaatttatttgttcataattttagtctcattaaatttggatgaatatttcaatgataataatgatatggttcccattgtgtgctctcatcaggtcaggagacgactgtttttgtgatgacttcaattcattgtcaaatcacaattctatctaggacctccttgttagcagggactgtgtgagcactccctaggtttttcaccctcaatctctccatataaggcctccacactcaataggaaggcaataaaacaaggacaacaaatatgaaacatatataacaaagtaggccttttttattgatttgattttggagaaataaaatctgattttgcattatcagatgcagtagtttggtaaaagaacatacatttttaatttagataaatgaagcaaagtaatgtacagttttcccaagtggttttatcattttatatttctaccgagtatatgtgtaataaatgtgaaagttcaaatcaatgggagaaaatggatttttaataaagaatgattaaatattggttatcaataaatagagaaaaaaattatgatagatattgactttaccaaataaagctttggaagattgccagataagtctttaccagatacatctttggtcgattgcttatgccaaataaatttttgtagaacaaaagtgaatgtatgagaaaaacacatgtattagaagtcaacatagtagaaaataaggtaaatgattacttaaaaatattgcaaatgcttgcttagcaatgatttaaaacaatcccaaaaattggaactgttgaaggcatgaggagatgtgggcttttatatctgtgatggaaataaaaagcaggttaagttcaaggaaaaaaaaaatgaaatctatcactaggtttgacaatatgtatagtatagattaaagcatttcaatttgagctttatcttacataaatattgagagatatgctcggagatgtgttgagaaggatattcattgtacaatatacaatttgctttttaaaagaataaatttcttattcaagtacaacctatgagataccttcataaatcaatagttcacagtctgatgaattatcacaatgttataattataaattccaggaaaaaaattgatattttcacaaggtctgacaatatatgtagcttaaacttcaggattgcactttgagcttcatcttacataaatattgagagggacatacgctcagagatgtgttgacaagaatattcactgcacaatatataatgtacttttaaaaataaatttcttattcaaatataagttatgagataccttcctaaatcattagatcacagtctgacaaattattacaaagttataattcattcatgtaatcacactgtgatcaagaaatagaatattgtcagtatctcagaaaaccacttattaaattatctactcataactacccctacttccatcctagagatggcctgatttgtaatatgaaagatttgttttacctgttttaaattttctataaattgaattacatagtataaaaccttttatatatggctttttaatcaattattatgtcttatatgatatgtatgagtgtaagattcttgcatataattaagtgcagtactagtatactcatattaatggttatactatcatccattagatgaatacatcatattttatatgttagttttttttcaactggcgatgaactttgtacttcttctagggtatgctgtgaggataatgctcttacgaacactcttgagtatgtcttcttactgatatgattgcatttgtgttaaatagaagaataaagttgcagagtatgtatacattctgataggctagattactgtcagttttctaacgtggttgtatggtttacattctatcacagagtaggagaattctaactctttcacatctttaccaatttcagtctcttaagattttagcaaagccagtgaatatgtattattatcttatagttgctttaacttgaattttgatgatgattaatggggttgaacaactgtttgatgatcttggacatttgtaaagtgctgttccatatctcttgcctattttagttgaattgtctgttttccttaatgattcacaagagttcttcatatattataattaagtcatttatcagcttaatgttttataaatattacaattcttatggcttatatttagaccctattagtgttatcttgtcaaagaaaagtttctaattttaatatagttttatttatccctttctctttccatatatacctggctatttcctctacctgtacacatatcctgaatgtatgaagtatagacaataattttccttatctatttccatagataaaatattgcactcatccacatcagaatttatgtaaactgagttggcttccctacaactttcttgagagcaaagtgaaggtctattttcttttatatctgtaggaccagacagtacatatggcacacggagactcaaaaactttgaataaagtgtttctttgttgtagattatttagagtatttttaggctcatacacacttgccttgctctctgaatttctgtaggacatctaaatacaaataatgatgttttttgagaatctatttataatttcaatatctttgagcttcctaaattgctgcatttaactacaggccaaaataatctggtcataagagtgaatcatatacacatataggggctcacagcgcttcattgagatggccttttggggtagtacaataaacaatgtcataaacattccaatagaatgaacggtgaactcctatgtcctacaacaaaatatgccaagcttgccaataagtagcaataaagcttttcgataaactagtctcttagagcttgaattatgattttcaaggtgagattaataatatctacattacttgcaccactgcactccagcctgggtgacagagcaagactctttctcaaaaaaaaaaagaaatatgtatatatatatatctacattgcatgattgatgtgaggatgcatgaaagaatatatatatatatatatatatatacacatacagtaaatgacattcttaatatgtggaaattattatagttagttttttaaattgataattttaatgcttttaaattgtgtaatctgggtgttaaaattgactccaagttataagctagggagaaaaaaattttcatttgaaactagaagcttaattgataccatgtcttacacatctgtctgaaaataggacagtgatatgaattttgaaagtttatttagaattccatagttgatcaaataattgaggaagtaaaaagggattatctatctctgctatttaacttgaagccaagcttcaaatgagaaacttatgaattaaattatttaaaaatcgtacttaaaaataagatagtctgccagagagttgaatattcacttaaaatagttatcttattttgatttatttaaaggtaacttcagtgaaattattttctatagactaagacatatcatacttttatatccaataataaattcattccctacatttttattgtaaagagttgaagtgaaatttcttaatttgttaacattcagatgaattatataaatgcattaagcagttggcaggtaccaagaactctactaactgctcaagcagtagaaaataaattagacacaaattctggagatatgaaaaagctcacagtatcagggatggggattcaaagtgcaggtaccacaagttaatttagaaaatgttttgttagggcatttctcaatacatggtaagagaaagctctgataaaaaaattcatgctgtcaagtattaaaggtgaattataaaaaataacaacaaacagacattcaagcatgtgtactttgatccaagtatcaaatgtgatactgctagtgaaaaatgatgttcttgtctctgataggagtgggaaaaaagagtaacaaaatatagtagaaaatcatctagagacattttgaggagagtttctaaatcgccttaaaaatggaggagtttaattttcataaactgagttgccaatgaaaaacttctataggtaaatagcaaaaatatttattgtcttggtgattaaaaaatgatcctagagtatctttaaaagtatagttcagagaagcaaaaatatttataaccctaccacccaatgattatcatttttaatatttaaggtattttgtatcagtatttgttatctatgtatatatattgcttgtctaattgtccgtatataaacacatgtaatattttaccatgttccatatttaattttgttgacattttcatctcatatcataacattggtcttcatcaataaatatgcatcaaaaacctatttttgcaatagctttccaaacccactaatgtcataatttataaaatgatatatttcctcttcagtagtgtgtaaaaaagtctaactgcagatgcttgtcaatagtgagggagatatacatctagagtgttgctagttaagcataaagtataattttaaatttctttggtcactagcataatttacttgatatatttgtgtcttgcctgttcatttactttgcctattttgctttgttttaatttgggcattttaaaattttatttccatggcatatgtgaatagcatagaaatcaacactttgtcaccagccttaaacatattttcagtttgttgtttgccttttagtgttgtttttgacatttaggaggttggtgtttttatttactcaaatatttccctttccttttggatttcaggctagatactttaaaccatctgaaaattatgtgaatatcaaattatctattttttttcaagtactatggcttttttatatgtaatgtttcaatccatcaagaaattgaatagtaaagacttaatactcaccaaattataggtggaattttaatctttatcatttataacagaaataaaactagattgaaaaactatattttcccattgtatcttaaatggatatcttatttatttatttatttgagacagagtctggctcagttacccaggcttgagtatgatggtgcagtctcacaacctccacctcatgggctcggaccatcctcccacttcagcaccagagtagtagctgggactacaggtgcatgccaccacatccggctttttttttttttgtattattggtttcaccattttgcccaggctggtctcgaacttctgagctcaagcaaaaggcccacctcagcctcccaaagtgctgggattacaggcatgagtgactgcacctggcctataaaatgtaatctcattgcaaaactcaatgatgccatgcttctataatatgctattacttttttttttttttttttttttttggagacagagtctcgctctgtcaaccagttgcccaggctagagggcagtggcgcaatctcggctcactgcaagctctgcctcccgggttcacgccattctcctgcttcagcctgtggagtagctgggactacaggcacccgccaccacgcccggctaattttttcgtatttttagtagagacagggtttcatcactttagccaggatggtctcgatctcctgacctcatgatccacttgcctcggcctctcaaagtgctgggattacaggcctgagccaccgcgcccggcttattacattttttaacacaggttttctctagtagaagagagccatgatatttaggattatggatatgtgtgaaagctagacatttaaaaagcacacaatgacttgaaatatggaattgggtatcaaataatctggatttacggaaaactagtcacaaaattcatggagataaacaagatggaatgccaaacaagaaaagaccatgtaattgcatttgttaaatgtctctaatgtgttccacatccacttcccaatctctctctcacacacacacaacccaacaaaactgctttccttgtaaataaaatttgagggttgaaaaccaacatgtatactttttgcattacacatgtactttaattatcattttaaattcctatattaagttaaaaatacatatttagattaattttattggtttaattctttttcttcaacagtcaattgacagacgtctttgagtacttttattctgaagataatatgaatccttgtatatatgagaatgatgtttcattcttaaataaaaatttgattgaattttaggttctctatttacaaactttttctttcaatgcactgcaagttctacctaatctttgctttctttatgctttcttctttaaccatctggtagaaatttgcttttatcctagaaataaatatagtttaccagggattttccaagtatttgtctgtgctttaactgtgattcataattaacacttttgatctgcaaacacaggttctttatataacccttgagtgtttttgtctttgtttttgtttttccttacagtatctttgttattgtacttgcttacttctcctggtttattaataaacacaaactaattacatttttatctggctctctgatcttcgttgctttattctcctagtcagttcgtctgtagtctggaagatttttcaaacatgtaagagcatactataaaatcgtagagagtgctttttttaaccaggctgatgcagacaaagtcttgcctctcaaattagtttctgtgaactccaccttttgctggtctataaaataaagagtaatcttaccttctttaccaagaggtttgtttattaactgtggaaatgcttgtaaaacacctactaccattgtcctatcaagttctaaaaaaatatttgttattattgtttagagtcgcagctttgctttctgcatcttaaatcctatctttctgtcttaaatctcttcagtttaattatttcatttttcttctgtatcaatatctttatttaactttcaatatcatcctatatattccattcttaattaaattttatttcttatccaaacttttaaaaataatttaatagtgtttcttttagtcaatcttattaaatatatgctcccccctgcctttttatcttcagtgtaaaatgctgctctaatgttgtggaatctttcaagggattcaagtgtgtttgaaactgtgtattaagcgatgatcactaccttgctgactgcaaagtttccatatttctgtggtggagaggtagaaatctctcctttatccctgtctacatctcttttccctctactgctgctttcttacactagtcttggcaaaaatcgtacttagaccccttgtttctagtgttgatgcaacttgtcatccctttttgctgtctccacaagtacatcaatagggccatgagtaaaactaatgcagatactagtagctgcctgacatttcaattcagacctactctatgtatttcaatccaaacctactttaggttaagagatggaaaatgacatcacagaagaggtgttagttaaaactatgttttcaaagattgatacttcgaggcaaagccttctcctctaacttttccagatagaataatattgattatcctcactattcccattaaaatatgctttcctctgcattagattattaatcagaactctcacattcttagttcatcatcatatattttatagcagtccagtccagaggaaagcatgctgccatcagagccagaacgaccaaggtcttcaaaactcttctccacaacttattcattatgtaaatatatctttctaaatatcaacgttgtaagtgtataatagtaacattaatttacaacgattcatatatcagattagaccaattaatcctatgtcattttaattatagaacttttctcaggatttttttttttaaagtaacattagacggccttgcagtgactgtcccagggaacattcaataaatattagttttataatttcttattattctatttatgtataaatttctttctgatctgtactatagttatattgaagagaatgtctatttctttcatgttagtgccttacttggtgcctgacacattgtagatactcgattgccacttattgaatcaaagaaccaaggtattgattgaattatgggagtaaaataattacaacatgttataaagctgggagataggaaaatccaaaagaagagatacattttggggaaaacaattacctagtaaattcgattgaggattgggtttactagagaaatatcattttaaattcacaattcagaactggagaaaatttaaaagagtaagaaacagaaaaaatgaataaaaataactttgttttgatattaattttcatatgttgattgaaccttcaatataggcgagaatattaaagttactgcattttcctacagtttttttgggtatattctatatggaatgaacacagtggtttttattgtcagaatattcaaatattactactaatagcactatctgtcactgatcacattcactagcacactgtagaccctacatgtacatcgagaatattgagaaatctgtgacaacagtgagttatatattttattgacttcctctagttctgtatcatccagcatagaggacacataatactttacaaaatatacccttgctgtatgaagtaccaacatttttagtttcatttacagaacaaattctgaactttgtctctgatataaattatgttatacagcagcatttaaaagagatattagtgattagtgatttctttttataaatgcaatgtgaactttagtaatattaaaataattttgtcaccttactatatttatattaaaatatgcatatggtaatgcttgctataaattaaatcatataaataactgttccttttacagctggtttgaaaacattcttttgctgtcttttaacgtagattttagatctcaaatactgtatttttaatttaatagaacacatggccatttaatactaggaagaaaaagagatgttaatgtcattttccaatagtatttaatctaatatgttaaaaattttaaacatatacagcatttgtgcattagctttaggaaaaatacactagcagtaattatattctttgcagaaacatttctgaaattaacaaaatgaggaatataagtaaaccatttttaggcattgaaaaggataaatttatcctaaaagatgttgatttcagactcaaaataccataaactctatctgtttcttggtatttaaaattgaataaagaataataacatcctcttattaccaagaggacctactgtctcaccccgtggttagtgtatgtgacttaagaagcaatgattagaatttgtagagatgatgcaagtctcacattgacaaaaagaaaatttagaaaacagcaatgctaaaaatagaaatgcacaccaggatatactagcaacataaagttttaatgctttacagagctcatataacctgaattttctgagaatacaagaggagcgaaaataaaggttcatttttttgatagatagtcttggtgggattatgtctgcctcactgaacagtataaaacatttggcagagcatgtataataaccaccaatagcatggttcccaattcactcttactcaactcccacagctagcatctgaatcacaaacagaatagaagcttcccagaactcaaccactggcaacatttaaatccctcagcatactgaaggaccttgggagattagggtctttttgtggaagggcaaactgaaacacttggttttaatgtttgaaattatcatgacctaaatttgttttcacacttctgttttgtccttgtagtagaggtgactactttaaccacagcagggtactgttgataactctggatgctgatgcctgtaaggcactgatagatgcttcataaatctttttcaaatgacattcttgatatttgcccaccgggtctctggaagcatctgctaaacttctcaatttgtcttcagaatttcaacgtaattttttttctttctcctttctgcattggcaacaatttatgtcttccacataggatgtacttctttcacactatgtggatatttttaaaagtgtaggtaccatcacactcgcatcagaagcatctgttaaagtaatcacactggtgggggtgaccccagaaagcacatattctcataacaccttacaagagctgtaggtaatttgtattttggacaaacatgtcagactttttttatgtacaaaaaagatgtatacaaactataaccttttaaccctttctgataagccttcctatatcctgacatcgatttccttcttttacttgtttctctctcagtactcttcaaaaagagaggtggtgaccagtgttggaagagatgaagcagatgcacatcacttcctttgggaacttgctgaaataattctttgcattgcattttcatttacattatgctgaccagttctcttcacttagaactttcttagttgttcttttgattcttactgttgaaaaccaagattatgctcttgtgatgaagtgttttcaaatatcaaaatctgaataattgggcagcccactttcagaatcttatcatgaagtttatgctgcaaaatgtcagtttaaattgaaatattcaaactagtagcaaggtaccaatgataagacatccacagacccaaaagttaactgaattcatatgctattttttgctgaacttatctaactggtagccatacacagcaataaataggctggcaattatgcatgggggaaaatggagtttcaagtgtgtagtatcatgtctataagaataatattaatgatagcctgaaagcccactcagatatctcacagagcctatactctgtaacttagctatcatatataatctgtcctggggatttacaaccctggcccaagaattaccaggcatctatgaaaatgcgacctagaacaccagttgccctagagaaaaagacgcctcagcataggtgcaaatttcatagatgttaaaacaaagctaacccttacaagaataacttaaactccttatatgaaataaacatctgataattgaccaggactgaatacagatgtaagaaaggggaagacctccccaaattccgagaatagtctccggaaggataccctcccagctatttggtggccatgccaccagcctgctcccactgtcttgtaagagcactgccacaataaaccacttgggaatcaggtgatgtctaagactcatctttgaagcgtatcctactgaagagaagaagttgcctctggagaagatggtcagctaggctcacctaagaccctggagtgcaatggcagaaaagataaaaaaaagcatttaatgatgatctgatgactaacaaagcaactaataaataagttaacttttaaaggtaaagatgaatcagatggtcagctttacttagaaatatttgagataggttgtcctaattaattaaccaacaaacacttattgagagaaagtgagtagattggaagtagactaacatttattgatactctacttgcatctggttctgtaggtttaattttcacaattctactgttatagaacctatcaaaagcttcaagtaataagtaatatagattgaatcagaatctgactttgaatactctgttttttggatcaatttgactttccaccattatatgtgtaaggctgctgtttcctcacattacctacctgtcctggctgattgtacctcctactattgtgtttcccattccttagtatctctggtttatttttcttattaaaataagccaaaactttccttttccaggtttttcattggttatttctttagccttccatttatatctcacatttcaactcaaattctccttccttagagaagcttcactgaccactctagttaccaaagaatgctgtcttcttaatagtatgtatcagtgcctgaaattttttgttgaaattttaatttcctgtcttcttacactgaaatgtaagctccctgaagcagtaaaataacaatgtctatatccctagtacataaaacattgtcctgcactaaaagtctttcttgttcatgccttcattcactttctcattctctctctctcgatagattagatagatagatagatagatagatagatagatagatagatactgagatagagatatagtgtgtatgtatctataactgatggactgatttttttaggtaatgttccttgtcaaggagttgaaaatataattgtaaagaaagtttaactaatatatgatacaactaacaattaaaacaatgtatagtatgtggaactcacctactgaattactgagaggacagagggttgcgttatgagggaatctgaggaatacagatatcacttcacatttcgtcagaatttcacagtttaacatatattttatttcatttgtgcctcataggagctgtgtgaaataaagagaattgtcttctttttttttttttttttgtcaaagaagtcaaatgacatctcaatccacaaatccagtggtaaggcaaggttccctaaagaagataaacttgctaaaaatactaccctcctttgtttatttttcagaaatttaaattgctactcttcattgagaaaattagagcaaatgatgagattttttaaatctgctactgtgagtacgtgtatgatatttgatgaagttagcttgctgaaggcatcatagatcaaatccctaaaacaagaaacattttgtggccttacatgtgtaggattggagggtgtatgcatacactttcagtatattctagaaatcagtgagctacagtgtgatgtcatacagatatatttggccactgaccaaaaataaaagcatgctatagaagcattcgtcttgaaacaatatacttgccaaactgtctttacattggaataagccaatatttttatattttatatgtgcaggcaatcaataaaaaattgctaaggaacagagtctctattcacagtcctctgcatggggcacggcccagtacacattaagttgacctactgcatgatgtccagtcagtattaaaagggcttaacgattaaaaaaaaatcagatgtttaacatgtaaaagataattaattggtacattcaaagtctctcattcttttttgggatcatcctctgtgcttgatttttacccaatatttcagagccatttctgccagtgatgaaaaactggagatgaggttgcttagacacagcaaatcctgtatagccaaagggaagctgaaggtcaaagagtgaattagattgatgtcttgttcttgttgaaaacagaatttatttgttttgctgacagagaaggaaaatataaacagtcaagaacgggaagacatattattttgctataaaatgaattcaagaggaaataacagatataaggaaaaacacagtgaatattattataggaataattcattagaatagagagacaatgaacttaaacacttgctaattctcctgctgaaatggatcaagtgattgcttcgactggagaaaaatcctaaactaacctaaatataaatgagtgctagaggacaggcagaatcacatcatgacacagacttaaaggcagagccagaagtacaataaagttaagacctgagctctccatataaaacaaaccttgtgtaacaagtgaaccacccaggtatgtctttaaatttatttttgaaacattagtttctgtccttaattattttctaataaaaataaaatcatttgataaaagaaatacaataataatatccaacgtgaataaagtctgaagactcagagggaaaatatttttttcaataactgtaatcatcgtatttctccaaaaatctcatttgcaaataatattgtgaaaaaaacaattttcgtgatataactcacaaggcagaagtctgatataaaacataaaatgtccttttgtttttcgttttgcatttatttcttatttcatcctgataaaaatgaatgcatgcagttttcaatatgagcaaataagtttttttccatatatcctttaaaactgtcttattcacttcgaatcttataaaatatattcatttaaattatatttatagaaaatcttcttgagaaattatgaaacttctaaatttgaggagatagtgacctaaattactttaaaggtaatcttgatcataatagaatgctgcagaagggctcaaagtttcacttttagaaagtaataaattgcatggcatttaacaggcctactctaaataagccacagccttgaaaagaaaattgctttagacactggtcctcttgccaatgtactgatttctattattagccaacatcttctaccggcccctgtctggggtcaccttaggtctagctgaagctgtatcctcagggccctgaatggattcagaatcagcatgcaacatgcttgtggtggcagtataaaacagtctacgtgagagaatggtccatgagagcaaaatcaatgtaaggataaatgaatgtagatgggatcaccaatcccaaatatgttacaagaagagagtgaacaaagtgacacggagactaagagaagataagaaaagaagtagaaagcaaacatagggtgagtattatggaatagttcttgagtaaaattcagtaactataaaattataattactatggctctatctgttaatgtagtgggctatttaataagccaaagcagcaaaaactagggcattactatggattagttctctgtgtgtttcctgaaacctagagaagattgtaggatataaactcaattgtgtcctagaaactcattttctatgttccagtcttgtaaattctacaaggttctagaaatctgtagtctaagaggcaataaacctaattatgaatatactaagacttagtcccttccaggaaaaagataaagaaaatactagtgaagattatttccttatgaaatgtaaacatggccttaatctagactaaaatacattttttcctaagaattttagggattaagatagattttctgtggtagtaacaggagcacagccgctaaatttatgccactagaagcaaggaagatcataggaaagatataacctgtcaactttgattcattttgagaaatcagtactcatgtaatgacggtaatggtatttatcgtatgtaaaataaaaccataataagcttttaaaatagtttaaggtacaaaagagtattttaaaaacaatgaatttgatctcttaaaatttattatagttttgtcacgagttttattagaagattttccatgtgttctttctgggagaaactatttaaaaagtccattaactttttctaaatgtttaattttttttttgagaaggaatctctctctgtcgcccccaatttttatttaacatgagttaccaaattagggtcactgcattcttattaactatgctagtttaaaaaaatttatagaaactttttaatgcttaaatatgccatcatatcactgccaacatttgtctctttttaatcaatatttaaagtaactatttccagtttttcattttaatgatttatatagtctttaaaaacattcataatggtttcagtggaagccatctctgtgttgatttttatgcttttatgtttctttctttttttgagacagagtcttgctctgtcacccaggcaagagtgcagtggcgcgatctcggctcactgcaacctccacctccccggttcaagcgattctccggcctcagcctcccaagtagctggaactactactactactacaggcatgcactagtagtagtactacgactactactactacaggcatgcaccatcacctctggctaatttttgtatttttagtagagacggggtttgggcattttggccaggctggtcttgaacacctgacctcaggtgatatgcccacgttggcctcccaaagtgtggggattacaggtgtgagccaccatgcccggcctgatttttatgcttttaaatggcttttggtctcattctttacagtaatgaccgctgttggtttgataatcaaccttcataatgttcaaacagtttatatttctgcacatattttctatttaaatactgacaagtattgtggtcttagtctcttagagacaaaataatcataaaatatttgttaggataaaaaactgttaggataaagacataaaaatgaagttttagaaggaaatgtagataactgtttgaaaatgtaaaatcagtgagaccttatttattgtaggataataaatagctattaaaaatatacagatttaacactacatgaaaatttaaacatttttataaaaaagctatcattaatatgatcaatggataaatgacagattttggaaaaatagcatttaccagaatgatttgtaatacctataataatactaatgaaaattaataataataatacttcaaatagataagaaaaagcatattgctaattgaaaaagacaaagttgttaataggcaaattacagatgagaaatacaaatgacctgtaagcatttggaaaaaaaaatgtttaggttcattagaatttttgggtgtagtggatgcaagtattaaaaataatgtattagatttgtacctgataacctgtaggaatttcctacaagtggtttttaaagtaaagcaagatacattaaaatgtgtatacaagtattctattcttaacacacatatgcatattacatctattttttataatataaagaattgaatgtcagagtacatatcagtgttggaggaagagaataaggaggaagcacagaaagtaaaaaggaaaaataggcaccaaaaaagatttggagaatggcagatggccaaggagatgcagctgggaagtgcctcttccatggagaggaacccaaatatccagtaaaccgtcacattttaaacagatcttttgagagaaaacactgaaagttgatacagaggtgacacagacaccatggttgaagagggaagaaatggggcagtctgctcagagtcactagacaccaggactggcccatataccttgaacaaacccaaggaaggggtgagtgaaggaaccctgggacactacatacccacaatgtacttctgagatcctagctacaggagtttctacgacccccatagatctttggactggtaggagagctgcctcgagcacatgcagaggcacagtttgaacccacaccgagcccagaaggctttgttgtgcggtgcagctgcagcaaaatgcaaccctaggtgcccatcccacaagtctccatttcatactgagtggctaagttcctgctatctgccaggctgggagtgaaccgtgcctggcctgctcacatgcccaagataggccccatcacccatgctgcgtgattaaggtacatctggtccacatgcccccttgcctgtcaacgccttcccagacctcatgcctgaccactcctgcaagagggtgtccacagcacaacatccactgcccagcttaagtgttttgttaacagcctgggagaagttcaccaccctgtccccaaatcatagccagtgcttaaagcttagaggccagaggacaaatcagtgagcccaggcccgtgagctcagtcccgtgagcccagtcccaactccccaagactccagtacaccacgcagggacattgagctgagatttgtgacctaatctcaagtgaaggaggaggatcctccacagtcagaatgcagagaagaatgtggtatgggttctcatggggcatgggagctggacacccctccctttgcaagaccagacaacgaaaggtatggcctgatggtcgtagctttttttccagggagtatcctggcacagaatgcctggagtagctcaacaatgtgggagcagatggcttggggaaagcctagttggttgggcttgccgccagggcgagtgtctgtgggagatctgctgggttaggggagtgtgagctaggcagacaccatggttgccagctgggctgaaaatcacgggctgcaagctccatactggtgttgcacccattgtggcactgccctgcctggagatcctctacccttgaaatactgcattttctttgtctctacacttgaaatactgtattttctttgtctcatgttgtgttttgagacagtacaactcatacctaagttgtgtatcacagcaactgcggacataccctaaaacctgctctgactttggtaagcacagtagactggtgggtctctggagagttgtgtccctagagatgtaatcctcagtgtggaccactcctgagggaaggggagtgcagcctgccaaagcacaccatgagataaagaaaatgtggccatggcatcagccactaaaagggtcaccaccaaggcccagaaccagacttggagaaggaatcatgtcttgcctccatctccacttcccagtgcactgttgcggatgcagcagtagctcttcccataaggtcctagaaagtgtgcactgaaagaagttgtttctcatgatgctccagtgaggacaagcatgcaccaagaccccacctgccagctcttactcttaaatctgtctaccagattgaagtttgaattatagcatcacataaaaatacattgctaaaacaagcaacatctatgaaagccactgcaggaacctatctctaaccaaggaacatatatagaaacttcacccctgcaactacccagaaatgaagccaatgaatcacatacaccacagtcatactttcaaggagaataaaaaatataaaagccctgtgatggttaatattgagtgtcaacttgattgtattaaaggatgcaaaatattgttcctgggtgtgttttgagagtgttgccaaaggagattaacatttgagtctggactaggagaggcagaaccactctcaatctgggtgggcaccatctaatcagctgccagcacagctaggataaagcaggcaggagaagacagaagagcagacttactgagtctcctggctttcatctttatcccatgctggatgcttccagttcttcagattttggacttttgtacttacaccagtggtttgccaggggctctcaggccttcagtcacagactgaaggctgcacatcagcttccctacttttgaggctttgggactcggactgccttccctgctcctcagcttgcagatggcctattgtgggactttaacttgtgattgtgtgagtcagtgatccttaataaactccccttcaaatgtacatctatcctactacttcagtacctatagagaactctgactaatacaaaccccatctaaatgaagcaaattcaaaaacaaagtatcaactcccgcagatggaaaggaataagcacaagaactctggcaatacaaaaagccagagtgttttgtggtctccaaagcctctcactagctccctagaaaaggatcctaaccagatgtaaatgtctgaaatgagagacatagaactcagaagatggatggcaaggaaagtcaatgagacataagataaaattgaaatccaatacaaagaagccagaaaaacagtccgaatttgaaagacaacatagctatattaagaaagagccaaactgaacttctggaactgaaaaattcactaaataaatttcgaaatacggttgggagtcttaaaaacagactaggccaagtagaaggaaaaaattcatagcttgaagactgattcttcaaattaacccagtcttgcaaaaataaagaaaaaatattttttaaaaagacaaagccttcaagaaatatgggattatgtaaagaaaccaattctacaacttattgatattcctgagagaaaagaaaaaataaccaacttggaaaacatacctgaggaaaaatttcaagaaaatattctcaattttgttagagatgttgacatgcatacatcagaaatccagagaaccccttttatatactataaagacagccatccccaagacacatagtcattagactatccaaggttaacacaaaagaaaaaacaaatctcagacacagctagagaaaagagcaacactacccacaaagggaaccccatcagactaactggtcttctcagaagaaaccttacaatccagcagagattagaggtctatttttagtactctaaaagaaaagacattccagaaaaaaacattcatattcttcaaaactaagcttcataaacgaaagagaaatggagtctttctgagtcaagcaatcggtaagggaatttatcaccaccagactagccctgcagaaatgcttaagggagttctaaatgtggatgtgaaagaacaatacacacaaaagcagagttaagtacatagtccacagactctataccacagactctataaagcaactacacaattgagactgcaaagaaactagctaacaaaactatggcaggaacaaaatctcacatataaaagttaaccttggacataaatggcctaaatccttcacttaaaagacatagagtggtgaattggaattaaaaaaaaaaaaaagaatcatccatctgctgtcttcaagagacccatctcataagtaatgacactcatgggttcaaagtaaagggatagagaaagattaatcatgcaaatggaaaacaaaaaagagcaggagtttctattctatcagaaaaaacagatcttaagcctaaaacagaaataaggacaaaaaatgttattgcttaatgacaaagggctcaattcaacaagaataattaactatcttaaataaatatgcacccaacattaattggagcaccaagattcataaagaaatcactactagacctaagaaaagatgtagacagcccctcagtaataactggggacttctacacccaactgacagtggtagatagatttatcgaggcagaaatctaaacaaataaattctggacttaaatttgacacttgaccaattaaacctaatacacatctacagaacactctacccaacaaaccacaaaatatatatttttctcatcttcacatggaacatactctaagagtgatcacatatgcagtcataaagcaagtgtcaagaaattaaaaaaaatattaaataataccaagcatcctcttggaccacagtagaataaaaataaaaatcaatagcaagaggaactctaaaacgcagacacaaacacacacacacacacatacacacacacacagaaactaaacaaattactcttgaatgactttcatttgggtaaacaagaaaattaaggcagaaatcaaagaactttttaaacaaatgaaaacagagacacaatgaacaaaaacctctgggatgcaacgatagcagtttaaagaggaaaaattatagtgctaaatacatcaaaaagacagaaatatatcaaattaacaacgtaacattgcacctaaagaaattaataaaacaagaaaaaaactatatccaaatatagcataagaaaataaataacaaaaataagaacaggactgaacaaaatcgagattcaaaaatccatacaaaggatcaacaaaatgaaaagttggttctttgaaagtttaaacaaaattgatagactgctagcaagattaacaaaaaagagaagatccaaataagcacaatcagcaataacaaaggcaacattagatccagtcccatagagattcaaaagattctcagagactactatgaacatttctatgtgcacaactagataacctaggagaaatggataccttcctggaaacacacaacctctcaagattgaaccaggaagaacttgaaacactgaacacaccaacaatgagttacagaattgaataagtaatagaagtccgggactagatgaattcatagctgaattctaccagacatacaaagaggagctcatgccaatcctactgaaactattccaaaaaatcgaggatgagagattcttctctaacttactgtacaaaacctatatcatcctgataccaaaatatggcaaatacacacacacaaaagaaaaccctaggccaatatatctgatgaacatagatgaaaaaatcctcaacaaagtacttgcaaaccacatccagcagcacatcaaaaagataatacaatatcaagtgaactttattcctgggatgcaagggttgttcaatatatgcaaatcaattaatgtgatttatcacataaagagaattaaaaatgaaaaaaataagattatctcaacagatacgttaaagtatttgataaaatccaacatgccttcataattaaaaccctcagtagactaggcatttaaagaacatactaaaataataagaaccatctattgacaaacccagtctacattatactaaataggcaaaagttggaggaattctcataagaacaagaacaaaacaagaatatccacttttaccactcttattcaacttaatacttgaagccctagccagaatgatcgaccaacagcaagaaataatagacatccaaataggaaaagaggaagttaaattttatttcttcactgatgataggattctatacctagaaaaccctaatgattctgaccaaagacgcctaaagttgattaaaaatttcagtaaagttttaagataggcaatcaacatacaaaaagcagtagtatttctatacaatgcaatgttcaaactgagaaccaaatcaagaacacaatcccatttatgagagccacaagagaaaaaaatgaaatacttaggaatacctctaaccaaggaggtgaaagatctctttaagtcgaactacaaaacactgctgaatgaaatcatagatgacacaaacaaatggaaaaatattacatgcttatagattggaagattcaacatcattaaaatgtctttactgcccgaagcaatctacaaattcaatgcagttcctatgaaactgccaaaatcattttttacacagaattagaaaattgattctaaaatttatatttaactaaaaaagagcctgaatagccaacacaatcttaagctaaaagaacacagacaggggcaacacattacctgacttcaacctatactacaaggctacaataaccaaaatagcatggtatgggtacaaaaatagacacatagaccaatggaacagaatagagaatccagaaatgaggcctcattcctacaaccaactgatctttaacataattgataaaaatgcaatagggaaaggataccctattcaattaatagtgctgggaaaactggctaaccatattcagaagaatgaaattaggctcctgtctctgaccatataaaaaaattaactcaagattgataaaagacttaaatgtaaaactttaaactataagaagcctagaattagacctaagaaactcttttggacattgacgtaggcaaagaatttatgactaagtactaaaacacaaaagcaacaaaaaacaaaaattgacaagtgagaccaaattaaactaaagagcttctgcacagcacttgcatgttctattgcaaatatgaaatagcaaaggcatggaatcaacattggtttccaacaatggtggattgtataaagaaactgtgatgcatatataccatggaatactatgcatccagaagaaagaatgaaatcctttcctttgcagtaacatggatgtgcctggatgccattatgctaagcagatgctgggacacaagaaaaatctttaagatatgtcactgcttcttatcaataataatgttctagtgagtaacaagagttaagaacaccactaattatagtactgtaaatataattacagttctaataagacatacacacacagagaacaattttgtctggtggttgaggaaatcttcattgatttaagatattttttgatgaacaggatttttcaataactatcagacgaagaatgtctatgacttatttttaaaaactattttcttctctgccttgcatatctgacattttcatctcctatcttccttgaatacaatatagaacctgacatttctttcctttcaaagatccttaaaacatttcctacatttaatctgaatgtctttctcagtaatttttcttatacaagcaattatggctacattttcttaatataatcatgaaaaagtgagcaactgaaaatttaatctggagaatatatatgaaacatattcaattaattcaagttgttgttaggctgcatatgttcagctttcagtgaaggtgattgataaatgagaaactgaaagaaaacaaaccaataggtgtttttcagaaacagtattattaaaatgcatgtgctttctactgaatgaaagcaatatagactttttcctcgcattggtagttagtaaggtgtataaaaacgactttgtaaagaacaattaatataggttaatgaatcactgtgaagaggggataacactttattctagcaatgatctgcaaggtgttaaaagttaaaaaagatgaaaaacaattgaatagttatttcatcatagtgtttattaaattgattttcctgtatctgtcaagctttacagaaatgtcttcaacagaataacagtgttggaagccaaatgaaatgcattatgaaatatgattcttcacttggtatgcaggtatactctcaggtgttaactcaggcaaagagacaaattcaattttaaagttccatttgttaaaatttgatgattgtgattaaagacccataacaattctatctttgacattttagttttttcttcacagaagcattctactgcaattttcttagttttctttcctcttaactgtggtattacccataaatgctggatttctctgttttaagtgtaacaaacctacaatcaactatttctggaacaccacttcatcttaacaacaaggacccataaatattctaaaaattcaaagtgttttatataaaatgttaaatgatacacataataaatttctaagtagtaattatgattatgcccataattatacccataatttaaaaatatgttacctgaagtaaattattacatattttatgttggaagtattcatttatctttgatctcttttaacacactgtactaggtggtaataaaataaactgccttattgggtagtcatttatcttttgtttcatattttttactggactaatattccaacgctatagatagtgaaatataacattcaaacaatttgatagtagtcaatgaatccagtttttaaaaatgggatccattttctaaaattgagtatatagatacttcatgaaatgtcttatcatacatcctaaaccaaaccaacctcttcccttgactgtcttacagtgcgttattattttatccactgcagcaactagcacatttttcagaacctagtagatattcagtcattgtctatggaatacatgaacacattctaaatttggacagtcatcattcttggtgttttaaaacaaacacttcctgaattgcacaaactattttctaaatagccctgggaattcattgaaggaaggtatgggtaagttgggggtcaaactataaagatgtaggttctcctctcaaaacttcttcagcgtatcctcattgttgtttgtttgcttgcttgcttgttttgaaagatctagatatagtctaatgagagttgtataaatgtgatgttccacaatgattctaacttacatggtgcaaaataataaaatattacattctagctgtttgtggaaaatcagggataatataaaggatctagattttctctctcctctcctcctaagatttattcactcagcaaagttacctggtgactacttactgctagacactgttttagatacttgggctataacgttgataagaacagggcttgaattagtgaaaagtttattttaattagctgtatggcaaaataggaaactaacaaaaataaacatataacatgtcagatggcaatggctgcactgagaaaaatgaaggagaataagaagttctaaattattatatatgaccaatattaccaacatattatagaaagaaatgagttcataatgtttatcagagaatttcatgaaaatcactaaatttttccagaaagccaggcactgataagggaataaacaaacagataaccgattttaatttgatcttctcttacaagtgcagctatgatctgccattgtatataatttaaattttaaaattgtttatatttctttcacataattatgttcttacattttgtttgtttgtttgttttgagacagagtgtcgctctgtcacctaggctgaagtacaatggtgcgatctcggctcactgcaacctccacctcccgggttcaagcgattctcctgctccagcctcctgagtagctgggactataagcaggagcccccacgcccggctaatttttgtactttattagagacagggtgtcaccaaattggcgaggctggtttcgaactcctgatctcagattatcagcctgtgcctcagcctccaatagatgctgggattacaggcgtgagccactgtgcctggccaatattcttacatttaaagatcagacatctatcagattcccttctccctgctacaaacattgtatacttttccataggcacaagattttgttttcattcaggttggactcaacaagtattatttagcagttcattgcatttatccatttacccaatagaggaagtataaaagatacagatgaataaagtgtaataattcttatactcactatttgcccttacatcatgtaagtgctcaactgtacaacatgtttgtgttcccaaaacctaactggaagggataactcagaaaaatagaataaaagtattgtatatctcatacatcttcattttagaatattgtaggggtacagatcagtataaataaaatactttggtaagtgcccaccacatcatctgtttgtcatccttagagccagattataccattctcattaagaaagaaaacttactactgtacctcctacccagtaacatatatatgatatatatatatcatatatatatattttatatataatatattatatatatatataaaacatttgctactggttaggagtaacactcagaaaatcatacttaataatgtagtacaattgggtataaattcacctagtatttttaaattttatgtatattcatatttatatgaatcatcatttaaaatcatgtctactgatcctgatggcattaaaggcataagaggtaccgaggatattaatttaattttgtttacagctatgcacagatatttttagttcactcagatttaatccagtagtctattatttgattaattgtacagctatcaaatcattcaggactcccactgtttcaacaagagtggaaaaatattttttcatttatgtttatatgcagctatttgtagtctaaattaatattctggcaattgatggtgaaattaaaattatttctgtcagatatggtaatttgatgacagtggataagcatgggagtaagagaaagttttgaggaagaggggtactttttgtttacttaatgattattcaaaagatgttaagtaaacattctatagaatgctacagatagtggaatacaacattgaaacaatttaataatgcagtcaatgaatccagtttttaaaaatgggatccgttttctaaaactgagcatacagacacttcatgagatgctttatcacgcatcctaaaccaaaccaactccttcccttgactgtcttacagtgcatagggtatctctacattctaggaaaggaattatctgtttatatgccacttataaaatcatacttaataatatagtacacttaggcataatttcacttagcatttttaaatgtaaaatgttaacgaaaagtgttcttgaaaaatatttctgagaatattttctaaaaaatgaacaaatcgtaacacctaagggatgatatctttctagtgaattgattatcagagtataatgtggtatgttctgattatgttacataatattctgattagcagaacattttaaataagtgaatttagcaaaatatttagaggttaaggaaactgttttacactgactatgttttctgacccaaatgtgagaaagaacccaataaaaagaggcagccagataatgctgttgtttgtgaacttaaacagaagcttgcatgtaatttattgttcaaagaaaaataaaaatagaagttatactttatttagaacttaatgacagtgaaaattacataaaaaggaagactactgaatacagcaaaagctgaaattatataggaaatataaatataaacacacaaaataagtgtaaattataatgaagtaaaaatatatcaaagagaaaaaaggaagtagtacagtaaaaaaaaaaaggtgatgctttaaaaactgtaattaaatagacaaatttccagccagattgatgaccaagtaaagagaaaaggaaggagacagatcaaaagacacaagatgatgaatgaaaagggggtcagcacttataaatgtagtagcaatgtaagccataatgagcacaagaaaacattatcaacttaattttgaatatataaaatagagacacttaaaaaaactgaacaaaaacaacttactagttttaaaagaaaaaaaagtcatcaaacatatatccttccaaaagtatagacttcaaaagtatagccccagatgggtgaacaacttcaaaagtacagtcccggatgggtgaacataaaccacactttaagcaagaactctcagttataactgcttgcaattttagaggataacagccacactcctgaaccagagcttggcaccggctattccctctggaacacccttttatttccttctctaagcaaagacatggaatcaatctaaatgcccaccagtggtctgcgggataaagaaaatatggtatataaacatcatggcatactatgcagctataaaaaagaacaagatcttgttctttgcagggatgtggatgtagttggaggccattatccttagcaaactaccacaggaaaagaagaccaaacactgcatgctctaactcataagtaggagctaaattatgagaacacatggacacatagagtgggggacagcacacactggggctttttggagggtggagagttggaggagggagaagacaaaaaaaataactaatggttactaggcttaataccggggtgatgaaataatctgtacaacaaaccaccatgatacgagtttacgtatgtaatgaacctgcacttgtacccctaaacttaaaagttaaaaatgaatgaagcctgtcagaaccacccactttgtagtcttacattttccctagtattcccaaacccctttgcctagtcaacattttacaaagcgcttttcatcttctactgtgttataatttatatatttttagtgtatattttacacactttattagaatatgagttccttcaaggtaaggactgttgtttgttttgtgctccctgatgtattttcagagcctagaacagggcctggaataaaataagcagccaacactatgcgatgaaaattttttggtgggtataaatgcctttgattcgaaacaaaactcagtttaattgtgtgtgtgtgtgtgtgtgtgtgtgtgtgtgtgtgtgtgtctaaagtcaccctaagcacactgttaataaccctagaatgactgacgtgttcgtattatgcaattttttatttttttcatcatattgacagataaaggattctaattcctataccttttcaataatgcagaagccttcataacatttaaattccattcatggtaaagattcttagcaaataaagaataaattgaaccttgatcaattactttaaagtagttataaaagacctatagtgaatatcatacttcagtattagaagctttctctttaaaataaggaacaagacaaataattggcaacatgacttcttttcaaattgcacagcattagggatccaagccataaaagaaaataaaagacatgtggatcataaagaaaatataaaacgttacttacagacaataaagttgtctgcataaagattataagagaaagctaaaaactattacagtcaaaaagagacatcagcaagcttggtggaaacaaaacaaacaagtacaagttgtcagtgacctttcaacaaccaattaggaaaaaaatatatatatacgttaaatcttaacactgaaaagcaacaaaaatatggaaacagtgcttcttatatgccagattctgattgaaatattttacaagtttaactcatttaattttcccagtgattcttgaggtagaggccatatttttcttaactttaatagatgcagaaactgaagcacagagagcacttgacttgcctaaggtaaaagttaaaaggcggcagatgtagaattcattcacaacaatctagatccagagtatttcttgtgcccctgatgatatgccaattctctggactctatcactaactctattaaatgatcaagaacttgaaagaaaaaaatatttaaattagtccatgaacaggaaatgtccaagtcataaacctagtaatatttcccaaagataatgcttaatagtggtgtcattacaaccaaaatactaaaaaaatgtgcaagccaatctcaaatatgtgggagagaaaacccaatactaatttgaagaggataaaagagcaaggcatctcccttgctgacagaaaggcttcttataactacaacattcatactgaaatgctattatactagatctagcactgaaacaatccaggccactacaaatgaatgaaaaatgagtccagaaaaacacagatccatatatgaaaatttgttttataacagaaattgcattaacaaatcagaggttaaattttaaaaaccataaaatatttcagacaattaattatttatgtggaaaaaagtaaagttgactcattatcctgcccagtacacaaaaatcaattccaggtggacttaaaaacataatgcaaaagcaaaactttaacataattaccaaaaatgtaagtcatcatctttatggtatttaaataaaaaaaagacttctttaaaaagacacaaagaaagcaaaacccataaagagaaaaactgatactcttgaagatgttcaagtttaaaactcatgcaaaatagcaccaaaaacaaggtgaaaaggaagcttcacagaggtactagataattctgctatgtttaactagcaaataattagtatccagaataaataagaaagcaatacatcactaagaaagtgacacacaaccctatagaaaaatgggaaaaaatatgaattggtaattcacaaaagagaaaatccaactgaatactaaatattataagagaatgttgaacaagtcaaactattaaagcaatacaaattaaattgccaataacattattttattcccatcctattgaaaacaattaaaaattctgaataccatgtggtggtgaaaatgtgatttcatgagtatatagcaatttggacagcaaactgacagcatgtgagatagttgatgatattcatatgacccagaaattccactattctagaaaataatcttgtacatatatataataaaatctatataagaatgtatactgcaacattttaaaattcaattaaagattagaaaagctctaaatgtatcaaaacaaagaacttgaaaaacagattataaataaatttatacagtggaagtcagtaaactgataaatcacaaaaacataagtttgagtaacaacatcaagttgcagtagacatgttcagtatatcatttccacaaattaacaaaataaatagtgctatatttttatggctataacacataaaggaaatatacatatgactttctagataggtattatttcttgtatctacaagtagaaaatggggttgcgcagagagggtgatagctacaattgcttctgtaattattctctttaaaatgatctgactcacaaacttaagagctggtggaaattcagcacgttttttttcctctttttctctccctgaaaagcatggaggtgttgtcactctcttcctgagtccctcagtgagcagacgtagagaaaaataccctaactgatctggaagtggaagatttaagttaaataaccttcaggaaaaaaggccttaaactgttttaaggcactaatattaaggtggtttcattgttacaggataacctagcatacgctgactgctattagaattcctgccatgaatcctaaaatatatgatatagtcttagtgatcattgggtgagtggcaaagcaactataactaaagctgaaagcatggtaatacatcttccgcagtgacaggatatttgataagactttcaccagcaaaaatatggaaggtacatgacattcctaataaaattgtagttccaagagaaggatggccagatttagcaaataaaattgcaaggcattcagttaaatttgatttccagatataaaacagatattattgtttagtaaaatttccatgtgatattatactaaatgattatacatatttgtactaaagaaaaacagtgttgtttacccgaaattcaaatttaactggttttctgtgttttacctggcaatcccatcaagagggagacgttgtgaaatagaaaagtagcaatatttcttggttactataaaagttatttaacaagactttataagggaacatgaagtcagagaagggggcaaaacactagtcattttaaaaactaggtggggaaatttggaagtagaggtgaccagatttcacagaagattgtagggtgagaggagtatagaggaagccaatataatacatcaaggtttatggtttgaaaaatggaaagatggaatatcaattacctgaaatgaagaaaatagcacacatttgtaatttgagttgcttattagcacccaactagagatatcaaatagatagttgaatatctacatctttgaattcaggagagagattcaaactgaagacataaatatggacattgacagcatatagatgacagtatactaagtttataaagataaaatagtaataaaagctaatattaacctcttttgtgtcagtccttgatgtaaatttttttatgtgttaactcactgagtccccacaataggtcgatgtaattggttctactataactacactctttaaaaatggatattttagtaaaaagaaggactcaatttatactcaccctcaatttgtagccattggtgtcatctctaagacaatttttagtaattgcctagtcagtgaaccttgccatagtccttagttatgtaaatttattgtattttttggaattccttttcattagccataacgctttaataacatatttttaaaattttgactttaacatctatattgtagtgaatatttaaagaacttcctccaagtttaggatacagaaatgggtaaattatgtctactccctcatatttcactattaagatgatggtaaattagcagtccaagagatcatggtcctgaaagtacagagaaaaaaatagaacccagtgacccaacataactaaggagcatatttgagacattgtcattcttggtatttctgaagaagcactgggatggaagggagttgagatcattttgtcagctacagcactaaattttggtcatgaatatcaaagtgattccatctttatgaggagcctgtggagaatggcaacatgctatatgtatacattttagaatggattaattgccatctgcgtaccttttatcaggttattctatttgttcagcatgccccaagatctcttttgtactttacaaatctgcacttcaattcttcttagttcgagactcacttcaacctaccgcatccttagttttctgcacttacttgttgtttctaaaaaagtatacatgatattatacaataaacatctagaattatacatttatgtactatattcacagaaattggacttgcctttaagccctcctttttacatatattcctgttattgtctcactgctaagtaatattactggatggcaaaataaaccaaaaaacacaaattgattttaatgaaaaatatcaatattaaatattagcttaaataacacaaataagtaaatattgaaatagatgggcatgttaggctgggcagctttttgtgggcacaatcatacaatttcaacttcaaattccatcatataacaggatgttctattggtacaatatctccttgttcacatgaggaaattaagtatattgatattcaccgaacaccaatttttaaatgtatttgaaattaattattttaagtgtctctcaactctcccaatagtgcacaaatatgtagttatgctatatactaataattaaataactttggaaactcacaacttcaaaaaaatgttcgctgttgtggaaagtttccgcagtagagaagggaatgtgaatggtatcagtcttagataacaagaaaactactttactttgtttcaactctactcatttgccatccaaatatgatagaagatgctgctcattcctaacaaatatttccagatatcatgcattccttaaaggagatgatactgattgccctctctattttcactcactttcccattacaattagcagcagattcttttaattatccctgcccttcttaaagcagtctcagatatataaaaattaattgcctggaactcacatctttataattttaaccttttcatgcttcacttatttacggtgacatttatctaaaacacttatcaggtgactgcgcatggtagacatctggtttatcagaaaaggcaggagaaaaaataaatgtaggacattaagcttgctatggtgctttgagactttcctagaaatcgttagctcatcaaaacttgttttggcatggcagaaagacatgtcccattaaaaggatattaatgcaagatcaccattgtcattaaaccatcataccatatattacacatttatgctgaaaatgggttcaaactttttattcccttatcctttaattattagaagaaactttgcagattatagccagataatttaaaataataaaatcaatgtcacttacaaggtcacaggatttagtaaaaccctgctacccatttccttttaagtaacttcgcattttagaaatgaagactgcctattcatgtggcttctgtgattttgttaaacattaattaacaaaatttctagtttttttttttttttcttctagagcagttcagtggaatgaaagaccttttttatcctatgcctctaaccacaaccgggtgtctctatcttaaaagatatttatcaagtctctgcttcatatttccttctctacaccattacagtcctcagcaagccctgctatctcatgatcgcaaatcttggccctttattgttggtcttctttctttcattgctacatgttagaataaatggtgtaagagaatgcttttatctattcaatttctttctctttggctcctgacccactgtctttgtttcagaataattatcagtgcctatatattaccttcacatatgaggcctttgttcgtttcattctttccatctcaattttctgtacattcgtattctctaaagtcttcatctctgtcaattgttcccttatctccctcaagtggacactgtcggcttttcgtagatgttcctactcaaaagagatcttgcaagccagtattttacattaagtaattgttctatttctcgacttttgctggcctataaatataacacatataaaggtagccattgcaggcacagtaaattatttgtctatgaaatcacaatgtttgccccagtatcttaatacaactctcaaatttatataattttttaatttaaaaatttaaaaataactttgcttaaacaaaggcagtttgttttctaacttatctatgtgtgtatgtatatatacacagaaatgtatatgtatacacacatatatattcataaattattgaaagtttcatgcaaattttttactttgccaatatgccccaaaacttgatatgaaattaattatacgaaggagtacagccttgtctttaattagctagaaaaattctcagcccacttaaataaactgttcccaacttggggagataaatttaaatatcttatcttggcaacgaacttataacccttaaaaacatttgctatggcatctatatattatatttcccttgatgtgaaaaataagaaacatttcagaaaaacccacaattaaagaatatcacctggcatcatgtctaaaaatgtataacagtaaaatagaaaagatttgtggatatgacaacaattctgcttgctttcaaaattattttttgctttgttttttgcaaagcctaattaaattaatatatgaatattgagtctattaatcttctctcttaaaaattcaaagcactattttaaagtaaattatcttaggaatattatctaagaatgaacttcatgtggtaaataccagcataagtcattactaaatgtgtttagggtatacaatggaagcagagtctgctgctaggaaaaattgaccttttgttttacaatttataatttatttagtgcagtatttgaaaatcatatttagatataacaggtgacaagagagctctatactaggaaagataattttagtactaccatctataaaagagactaataaatatgaaatgaagatgctataattaaactgtaactcttgcccatgccagcccaacataactattataaaattgtacataactatcaggctgttaatttgaggtaatattgcaggcactacaaaaaaaattcagtaactcatcaaaactattttcttatgaaggtaataaaagctacaatacctgcccatgtcaattatttaaaggtgttcgaagcaaatttcttaaataatttaatttctggagccagacataacagttgactttgtgctctttgacatttactactacagactgttgctaagtccaggcttcaagaactctcctgcatttattctttttaaatcaatggtacaaattatctaactagctatatgtgacgacagcagtggttctcagtttggttttaacaccacctggaaacctgcaaagtctcaggtttcaccccaggtctaccgaatcagaaacactagggataagccccaacaatcactgttttagtaggatcttcaagtgatttcaatgcaggttaagtctgaaaacactggaaaagaggagagaaaaagagagagagagaggagagatggagacaaattcccagaccatacactgcactagaaatagagtgttaggactttacaacaggttcaaaattttagagatgaattatagctgacatttgaacacaaaggaaaggagcccattagtccagggaacatctctgattataaacaacttcatttcctgcttaggtattattcaaatgtatatttaacagtataatgcttctctacaatcaagtaaagctcaaacaaatttaagatgtctttttttttaatgttgtatgttgatgagatttaaactaatagaggcttagctcaattggtgattaaggtgatgagtctgccctggaggtggaaataaatatttcattagacttgtgatgaattctagataattttgacactactagaatgattttgaaagtctggatgatttttgaccaaatatagacccaaatacaaatattgtgaataaaagtattgctaggatttagaaactttaacaagttacataatgtttaaattcatgatttctgtgggtaatttgtggtcagtgctttggggggcagaatgttaaagagatttctatatgagattatgagtaaaactttgtgacaaacaatttgaaaaaatagttgaaaagaagaattcagtaggtaaagttaaaaaagtagaccttactatgaaaaaaagagtagggatatatagaaaatttagatattacgagttgaatgtgtgcagacttcccaagatctatgaatgctataaggaccactacagttgatagcgtagagaaactaaggcaatatttatgcagtgttttagaaggccacagctccattccattactatctgatgatattttagcaaagctggactctgcagtatccttttttgtttgaagaggaatagtagaaggagcatttgtcactcttatttcaccttcaacttctcattatttcccatacacgctcctgttacaattcttgggaaataattaaaataaacttacagccttttatatgggtaatttaaccatatttactagtgtttaaatgattcaaccactgctaggctgtgtagaaaatacaagtactggtagttgtgtgaaagttagctgagtttagataagaggtggcctgaaaagtcaagtctcactagagcactgagattttaaaactattctctgggaactagctagctagctagctagatagatatagatgtttctcaataacaacaataaagaaaattatttcttcatgtatttattacaataagcaaaatattgactaataaaaacacaagaaaggaaaaatactaacaaaaaacatcctgaatactctatatactaaagtgtaataccaaaataaaaattagacacttagcattttctgtgagataaaatagaccaagcaatgagcctcgcttgatgcttcatacaccaggagagctggaaggatgcacaggttcagtaaaaacatgccaaaattaacatgagaagacatgattttatttacttatttatttattttttagagacagggtctcactctttcacctgggctgggatgcattggcacaatcagagttcactggagcctcaagttcttgggctcaagcctcctgagtaactaagactacaggtgcatgccactatgcccaaataattttaaaaaaatttttaacagaaacggagtctcactaagttgctcaggctggtcttgaactcctggcctcaacccatcctttcatctcggcctccctaagtgctggaattacagtcatgagccatggtgcccggcctaataaatgattttcaataaattatatttaacaaaatggattagaattaaccaaaaaataaaactagtaattcaaagctttaaggagtggatgtaggtatgtatctacgcatggatgtctgttaattttgtttctttttaaatcagagaaaacaaatttgaaaagatgctttgaaagtagctgccttcttattgtaattgttttaccaaatagcaaagtctagttcttcaaaattgtcagaacctgttatttatactccatttattcttatgattgggcaatgtgtggcacatttaaggattattttccagtatatcataaatatattaacaatgtgacactttaaggatctaaggaggactgaaaattttatctgaggaattcgttagtctatcacagaggtagctctttgatacctaagtcatcaccttttatagaacgtaacataaaggttgaagttttcacagaataagtaatactgtgaattttcagatagagtgtaaactcctctgggttggctggcttttctgtccttacagagctgcccattgtggtcaaattgaccacatgagaagttgatgatgcagttatgccatgcatagcaaccgcagcaggccttcctcattccaatgtaaatattcattatatgaagcattatctaagacccttttgccttgaaagagagagtaaaaaattaatcaggagtagagtctctaaaatattcatttccctggttcatggagtcatacaagcttctttatcatctcagcattttagtctagtccaaaagcccaaagactaaataaagtaattgatacatggcatccatgaaaataatacaagtaaaatatggctttatgttgactatgcaaatttcatatgaaagaaattgtttccaagaaacttaactcaataaaatttaaaccataaatatttttcaccaattttattcaataaatacttactgagaacctactgtttcctggccttgttatacttgtttggaattcatttgagaagtcaaccatataatacttcatgacattggtctaggcacaggtttttttggataaaaacttaaaagcacaaacagtgaaagaaaatttaaaggcatcttaacagaaaaaaaaaacaatcagcagagtaaagagacaacctaagaacaggaaaaaatatttccaaaccatgtatcagataagatattaatatccaaaatatataaggaactcaaacaactcaatagcaagaaaacaaataacctgattaaacaatgggcaaaaaaatctgaatagatatttctcaaaagaagacatcaaaatagccaacagatatatgaaaaatatatttaacattactaatcttctgggaaatgcacataaaaaccacaatatcatctcatcccaattcgaatattatcaaatagacaaaaaataacaaataatggcggggatgtaggaaaagggaaactctattacactgtttgtgggaatgtaaattagtacagtgtttatgaaaaacaatatggaggttcctctaaaaattaacaatagaactaccatatgatccagtcattctactactgggtacacatccaaaggaaatgaaatcagtatgtcttagagatatccacttccatgtttattgcagcactattcacaatagccaagatatgaaccaacctaattgttcatcaactgataaatgaataaagaaaatgtggtatatatacacaatggaataccattcagccataaaaaaataaatcctgttattcaaggcaacataaaagaacctgaaatgaaataagccaggcacagaaagacaaataccacttgatctcactcacatggaatttaaaagagctgatttcatagtagagagtaaaacagcagttgctagagactgagaagtagagtgagaaggaaagatggagagagactggtcaaaaaattcaaagttacatttgcacaggatgaataagttctggtgctttattgcacattagagtgattatggtaaaaagtattgtattgtatgtttcaaaatacttagaagaaagaattttgaatgtttttaccacaaacaaaatgataactgtgtgagatgatggatatgctgtataccctgaaaagattattacataatgtatagatgtaggaaacatcacactataccccataaatatgcataattattatgtgtcaaaaacaaaatttttaaaagttaatcactctctaatgaaagtatcttttggctcctagacacctgattttttttttccattttgccaaaagtcaaattctacatactaaaacaaagaatttattgtatcctttcaaaacaatatattttaatagcatctatagattcatcaagcaatgatgtaatgaacacaataaaagcttgagtaatctaactactttacaatagaaattgtaatgtttttgtttttgttttgtacgttcaatcctctgaaaaacatgactcttcctgatttttttttcttttttgaaaggagtcttgctctattgctcagtctggagtgcggtagcacgatctcagctcactgcaacctccgcctcctgagttcaagcaattcttcctgcctcagcctccagagtagcttggattacaagcaccaccaccttgccaggctaatttttgtatttttttagtagagacggggttttgccatgttggccaggctggtgttgaactcctgacctctggtgatccacccacctcccaaagtgctgggattataggcgtgagccactgtgactggccaatattttaaatgttaatgtctatcattatattttctcattctcttttgctgtacttattaaatggtctattatcctagaaaataggtaagaagatgaaaaacaaaccagtagcataagatctgaaactgattgataagttatacattaaatatatgatttgatttgcttaagacctctagtatttctattccttttttaatttttagagtttcaaaatttcattataattttggttaaatttactgacttctcaaaacttctaaagtttaatgaactatatacccatcagtgtattaagcagaaaaatagtttagaaaattgtcaccaaagtatgcactttgtatctgaaaacaataatgaggcttctctctgaccattaatcttgggcttttatgacacacaacaattttactattttgtttatttgcttggtttatagtacatgaagacagaaatattatagtttctgtttcatgtagcacatttctttaaaaatgtgttttaaaatgcctttttttctgcaaaactgaattccagtacctaatttctctgttactttggtgggccaggagtcctgccgagaagaatattgatgtctctctcatcagaggtttttgataatgtcaggtttccaatatatcctaggggtatatttttacctttttaaaacaaaatttatttttgcctatttttttcgttctaaggctctttatgacaggactatttaaagcactgaggacaagacaagatgtttatatatacttcctgctgtttaatattcatgcaattctgacaagattaatatactaatttctctgtcattagtttcattaacagatattaattatatctgaatctaaatgccaaatgaatagacagttgggattcaattctatttaagataatcgaagttctctttacaatcatgattggggtggcatacataccatctattctggttagagatggactctggacgctagataaaacacttgggattaaaacacttatcctagaacttatcattataggcacttcacataatgggggaaactgaatatttacaataaccttttggaatagttgatgatgatgatgatgggaaagagagagagaaaggccaggtgtggtggctcatgcctgtaatctcagcactttgggaggctgaggcaggtggatcatgaggtcaggagttcaacaccaacctggccaacatagtgaaaccccatctctaccaaaaacacaaaaattagccaggcatggtggagtgtctgtagtctcagctacttgggaggctgaggcaggagaatcatttgaacccaggagggagaggttgtggtaagccgagattgtgccactgcactccagcttgggcatcagagtgagactccatctctaaataaatacataaataagagagagagagaggagagagaaacatccttttttctggtaaaatttagagactagattgtccaatgaagatggctgaataggaacagctccggtctgcagctcccagtgtgactgacgcagaagatgggtgatttctgcatttccaactgaggtactggttcatctcactggttgaatagtgggtgcagcccacggagggcgagccacagcagggtggggtgtcacctcacccaggaagcacaaggggtcaagggatttccctttcctagccaagggaagatgtgacatactgtacctggaaaaatgggacactcccgcccaaatactgtgcttttcccaaggtcttcgcaactggcagacaaagagattctctcctgtgcctggctcgtcaggtcccacacccacagagccttgcacactgctagtgcagcagtctgagattgaactgcggggcagcagcctggctgggggaggtgcgtctgccattgctgaggcttgagtaggtaaacaaagcagccagggagctcgaactgggcagagcccaccacagctcagcaaggcctactgcctctatagactccacatatttgggcagggcatagctgaacaaaaagcagcaggcaacttctgcagacttaaaaatccctgtctgacgctctgaagagagcagttgttctcccagcatggcatttgggatctgagaactaatagactgcctcctcaagtgggtccctgacccccgtttagcctaactgggagacacctcccagtacgggctgacagacacctcatataggcaggtgcccctctgggatgaagcttccagaggaaggatcaggcagcaatatttgctgttctgcagcctccactggtgatacctaggcaaacagggtctggagtggaactccagcaaactccaacagacctgcagctgagggacctgaatgttagaaataaaactaacaaaggaatagcatcaacatcaacaaagcagaaaggaatagcatcaacatcaacaaaaaggacatttataccaaaaccccatctgtgggtcaccaacatcaaagaccaaaggtagataaaaccacgaagatggggagaaaacagagcagaaaagctgaaaattctaaaaaccagagtgcctcttctcctccaaaggaatgcagctcctcaccagcaacagagcaaagctggatggagaatgactttgatgagttgacagaagtaggcttcagaaggtcagtaataacaaacgtctccaagctaaaggagcaagtttgaacccattgcaaggaagctaaaatccttgaaaaatggttagacgaatgcctaaccagaataaacagtgaagggagaccttaaatgaactgatggagctgaaaaccatggcacaagaactttgtgatgcatacacaagcttcaatggccaattcgatcaagtgaaagaaagggtatcagtgattggagatcaaattaatgaaataaagtgagaagagaaggttagagaaaaaggagtaaaaagaaacaaacaaagcctccaagaaatataggactatgtgaaaagaccaaatctacatttgattggtgtacctgaaagtgatggggagaatggaaccaagttggaaaacactattcaggatattatccaggagaacctccccaaactagcaatgcaggccaacattcaaattcaggaaatacagagaacaccacagacactccttgagaagagcatccccaaggcacaaaattgtcagattcaccaaggttgtaatgaaggaaaaagtgttaagggcagccagagagaaaggtcgagttacccacaaagggaagccaatcagactaacagtgggtctctcagcagaaaccctgcaagccagaacagattgggggccaatattcaacgttcttaaagaaaagaattttcaacccagaatttcatatctagtcaaactaagcttcctaagtgaaggggaaataaaatcctttatggacaagcaaatgctgagatattttgtcaccaccaggcctgccttacaagagcttctgaaggaagcagtaaagatggaaagaaacaaccaataccagccacctcaaaaacatgccaaattgtaaagaccatggatgctatgaagaaactgcatcagttaactggcaaaataaccagcgaacatcataatgacaggatcaaattcacacataaaaatattaacctaaaatgtaaatgggctaaatgtcctaattaaaagatacagactggcaaatcggataaagggtcaagatcaatcagtgtgctgtattcaagagacacatctcacatacaaagacgaatataggctcaaaataaagggatggaggaagatctaccaaacaaatggaaagctaaaaaaagcaggggttgcaatcttagtctctgataaaacagattttaaaccaacaaagatcagaagagacaaagaaggccattacataatggttaaagggatcaattcaacaagaagagctaactatcctaaatatatatgcacctaatacaggaacacccagattcataaagcaagtccttagagacctacaaagagacttagactcccacacaataataatgggagactttaacgcctcactgtcaatattagacagatcaacaagacagaaggttaacaaggatatccaggacttgaactcattcatttgaactcgcacttataaaattgaccacataattggaagtaaagcactcctcagtaaatgtgaaagaacagaaatcacaacaaattgtctctcagaccacagtgcaatcaaactagaactcaggattaagaaactcactcaaaaatgcacaactacaaggaaactgaaaaacctgctcctgaatgactactgggtaaataacaaaatgaaagcagaaataaagatgttctttgaaaccagtgagagaaaagacacaacattccagaatctctgggacacatttaaagcaatgtgtagagggaaatttatagcactaaatgcccacaagagaaagcaggaaagatctaaaatcaataccctaatatcacagctgaaagaactagagaagcaagagcaaacaaattcaaaagctagcagaaggcaagaaataagtaatatcagagcagaactgaaggagatagggacacaaaaaaccctccaaaaatcagtgaatccaggagctggttttttgaaaggaccaacaaaattgatagacctttagaagactaataaagaggaaaagagagaagaatcaaacagacacaataaaaaatgacaaagtggatatcaccacagatcccacagaaacacaaactaccaccagagaatagtataaatacctctatgcaaataaaccggaaaatctagaagaaatgtataaattcctggacacatatgccctcccaagactaaaccaggaagaagttgaatctctgaatagaccaataacaggatctgaaattgaggcaataattaatagcctatcaaccaaaaaaggtccagggccagacggattcacagcctaattataccagaggtacgaagaggacttggaaccattccttctgaaactattccaattaatagaaaaagagggaatcctccctaactcattttacgaggccagcatcatcctgataccaaagcctggcagagacacaacaaaaacagagaattttaaaccaatatccctgatgaacattgatgcaaaaatcctcaataaaatactggcaaaccaaatccagcagcacaagaaaaagcttatccaccacaatcaagctggcttcattcctgggatgcaaggctggttcaacatacacaaataaataaatgtaatccatcacataaacagaaccaatgacaaaaaccacatgattatctcaatagatgcagaaaagaccttcaacaaaattcaatggcccttcatgctaaaaactctcaataaatcaggtattgatgggatgtatctcaaaataataagaggtatttatgacaaacccacagccaatatcatactggatgggcaaaaaatggaagcattccttttgaaaactggaacaagacagggatgtcctctctcaccactccttttcaacatagtgttggaagttctggtcaggcaaatcaggcaagagaaagaaataaaggacattcaattaggaaaagaagaagttaaattgtccctgtttgcagatgacatgattgcatatttagaaagccccattgtctcagcccaaaaattccttaatctgataggcaaattcagcaaagtctcagatacaaaatcaatgtgcaaaaatcacaagcattcctatatgtcaataacagacagagagccaaatcatgagtgaactcccattcacaattgctacaaggagaataaaatacctaggaatccaacatacaagggatgtgagggaccttttcaaggagaactacaaaccactgctcaatgatataaaagacacaaaaatatggaagaaaattccatgctcatagataggaagaatcaatattgtgaaaacggccatactgcccaaggtaatttatagattcaatgccatccccatcaagctaccaatgactttcttcacagaattggaaaaaaactactttaaagttcaagtggaaataaaaaagagcccgcattgccaagacaatcctaagcaaaaaagaacaaagctggaggcatcatgtaacctgacttcaaactataccacaaagctacagtaaccaaaactgcatggtactggtacaaaaacagatatatagaccaatggaacaggaaactgggctcagaaataacaccacacatctgcaaccatctgatctttgacaaacctgacaaaaacaagcaatggggaaacgattccctatttaataaatggtgctaggaaaactggctagccacatgtagaaggctgaaactggatcccttccttacaccttatacaaaaattaattcaagatggattaaagacttaaatgttagacctaaaatcataaaaacctgagaggaaaacctaggcaataccattcaggacataggcataggcaaacacttcatgactaagacaccaaaagcaatggcactaaaagccaaaatagacaaatgggattgaattaaactaaagagcttctgcacagcaaaagaaactaccatcagagtgaacaggcaacctacagaatgggagacaatttttgcaatctacccatctgacaaagggctaatatccagaatctacaaagaactcaaacaaatttacaagacaaaaacaaaaaaacccattaaaaagtggtcaaaggctatgaacagattcttctcaaaagaagacatttatgcagccaacagacacatgaaaaaatgctcatcatcactggtcaccagagaaatgcaaatcaaaaccacaatgagataccatctcacaccagttagaatgacaatcattaaaaagtcgggaaacaacagatgctggagaggatatgaagaaataggcacacttttacactgttggtgggagtttaaattatttcaaccagtgtggaagacattgtggcgatttcttaaggatctaggactagaaataccatttgacccagcaatcccattactggatatatacccaaaggattataaatcatgctactataaagacacatgcacacgtatgtttattgcagcactattcacagtagcaaagacttggaaccaacccaaatgtccaacaatgatagactggataaagaaaatatggcacatatacaccatggaatactgtgcagccataaaaaaggatgagttaatgttctttgcagggacatggatgaagctggaaaccattattctcagcaaattatcacaaggacagaaatccaaacaccacatgttctcatagttgggaatcgaacaatgagaacacttggacacatggcagggaacatcacacactggggcctgtcagagggtggggggctggggaagggatagcattgggagaattacctaatgtaaatgacgagttaatgggtgcagcaaacaaacatgccacgtgtatacctatgtattcaatctgcacgttgtacacatgtaccctagaacttaaagtataaaaacagaaattagagacattttctgcctcaaatagatataacgcatgttactaatttattaagcagaactcatcaagatgccaaaagataaaaatctactaaatcaatgatatagttaccaaaagtcaccctgtataattcatggatttaggacatgattaagtacatacttagcataattgaaaggtgtccacctgaaagcaacagtaatcacacacacacagacacacacatgagtcaatctgtcaaaattacacaccaagcttttaattaattcatcaattatacatcagtgtttctggattattagaattattttgacacattaaaaagtaaacactcctaatttaactcatattatttttgataaaggcattgtggtatgccatcatttcataatatacactgaaacatattcaaataaaatgaaactatatctgagacatgcttcaagtaatttgggaagaaaggatgggagaagatatagttggtgcaagtatgcctatgaattggtaattgttgaaactgggtgataaattcatagtgtggtcatgatggtcttctgtttttttgtatatatttgaaaattgctatataaacatttttgaaatacaaattcttaggccacattccagtcatattgaattagaataccctggagttgaagcttcaagtgagaggtgaagccagctgagcttctgggccggatggggatttggagaacttttgtgtctagctaaaggattgtaaatgcaccaatcagcactctgtaaaatcacaccaatcagcatgctgcaaaatggaccaataagtgctctgtaaaatggaccaatcaattctctgtaaaatggaccaatcagcactctgtaaaatgggccaatcagcaggatgtgggcggggccaaataagggaataaaagctggccaccagagccagcagcgtcaacctgctcggatccccttccatgctgtggaagttttgttctttggctctttgcaataaatcttgctggtgctcactcttagggtccacaccacctttaagagctgtaacactcactgagaaggttcatggcttcactcctgaagtcagtgagactacaaacccactggaaagaagaaactctggacgtatctgaacatccaaatgaagaaactccggacataccatctttaagacctgtaacattcactgtgaagctccgcgcttcattcttgaagtcagcaagaccaagaacccagtggaaggaacaaattccagacacatttggcaaccacgaagggataatcaccaagtagtgagtaccatcggacccctttcacttgcaattctgttctatttttccttagaattcaggatctaattatcgggcacctgtcggtcagttaaaagtggttggtggccgggcgcggtggctcacgcctgtaatcccagcactttgggaggccgaggcgggcggatcacgaggtcaggagatcgagaccatcccggctaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagggagccgagatcccgccactgcactccagcctgggcgacagagcgagactccgtctcaaaaaaaaaaaaaaaaaaaaaaaaagtggttggcacggccactggaataaaaacacgggtgtcaggcattctaggaaagggctctcttacaacccctgactcttcggggttggaagcattgatttgcctggaaccagcttccacttttcttgtacttctgggctgagccgagggtagacagagtggaaagccattcagctccagggtcccaacaacaagttggttgaccctgaggctgagcggaactctcaaagacatgtcgcctaagggagactcgcccatctctcctatctatcctgacccttgcctcctgggtcctcatgcctgtcagacaaacttcctcttgcctctcttctctgaggctagtctcgcttctaaaaaccactccctgtctctggtgcttttctagtttctcgtataagaatgatttctagcataaactttaggactctattcccttctttaggcacccaggctcaccaatcagaaagacataatttttgcccaaagccccatcggaggagccagactatcttatctggaattttaggacccctcctcaggctagcaggcctaacaaaggctattcctgaagctaggatatggggagcctcagaaattgtatccttgctattcatataagtgaggacaaaaggcatcactcttccaaccctggagatctcttccctctctcagggtatggccctccacttcatttttggggcataacatctttatagggcatggataaagtcccaatattaacaggagaatgcttaggactctaacaggttttctagaatgcattggtaagggccaataatccgaccttcctcattcctccttgtggtctaggaggaaaactagtgtttctgctgctgtgttggtgagcgcaactattcccatcagcagggtccagggactgttgtgggtgcttgggcaagaggggtttctgctgccacgtcagtgagtgtaactattctgatcagcagggtccaggggccactgtgggttcttgggcagggggagaaacaaacaaaacaaaaccgcaggtggttttgtctttcagatgggaaacactcaggcatcaatgggctcacccttgaaatgcatcctaagccattgggaccaatttgacccgcaaaccctgaaagaaaggcagctcatttttttctgcactatggctcggccacaatattatctctctgttggggaaaaatggccacccgagggaagtataagttacaatactatcctgcagcttgactttttctgtaagagggaaggcaaatggagtgaaataccttatgtccaagctttcttttcattgaaggagaatccacaactatgcaaagcttgcaatttacatcccacaggaggacctctcagcttacctccatatcctagcctccctatagctccccttcctgttagtgataaacctcctctaatctcccttgcccagagggaaataagaaaagaaatatccaaaggaccacaaaatcccccaggctattggttctgtcccctttaagtagggggaggggaatttggcccaacgtgggtacatgtccccttctccctctccgatttaaagcagatcaaggcagacctggggaacttttcagatgatcctgataggtatataggtgtcctacagggtctagggcaagcctttgatcttattggaaagatgtcatgctattgttagatcaaaccctggcctttaatgaaaagaatgtggctttagctgcagcctgagagtttggagatacctgatagcttaatcaagtaaatgatagaatgacagctgaagaaagggacaaattccctactggtcagcaagccgtgcccagtatggatccccactgggacttcaactcagatcctggggactggagttgtaaacatctgttgacctgtgttctagaaggactaaggagaattaggaaaaagcccatgaattattcaatgatgtccaccataactcatggaaaggaagaaaatcctgccttcctcgagcagctatgggaggccttaaggaaatacactccactgtcaactgactcactagagggtctattgatcctaaaagataagtttattacccgatcagccacagatatcaaaagaaagctccaaaagtgagccctaggccctgaataaaatctggaggcattattaaacctggcaaccttggtgttctataatagggaccaagaggaaccggcccaaaaggaaaagcgagatcagagaaagactgcagccttagtcatggccctcagacaaacctaccttgctggttcagagaggacagaaaatggagcaggccaatcacccagtggggcttgttaccagtgtggcttgcaaggacaccttaaaaaaggttgtccaatgagaaacaagctgccccctcatccatgtccactgtgcagaggcaatcactggaaggcacactgccccagagggcaaaggttctctgggccagaagcccccaaccagatgatccaacaacaggactgagggtgcctggggcaagtgccagctcatgtcatcaccctcactgaaccccaggtacgtttaactattgatgaccaggaaattgacttcctcctggacactggcatagccttctcagtgttaatctcctgtcccagatgactgtcctcaaggtccgttaccatccaaggaatcctgggagagcctgtaaccaggtatttctcccacctcctctgttgtaattggaagactttgctacagatagtaagtatgcttatctaatcctacatgcccatgctgcaatatggaaagaaagggagttcctaacctctgggggaacccccattaaataccacaaggaaatcatgcagttattgcatgcagtgcaaaaacccaaggaagtggcagtcttatactgccgaagccatcaaaaaggggaaggagaggggagaacagcagcataagctgctgacagaggcagggaaagaccagcagaaaggaaagagagaaagagacagaaagtcagagaaagaggaagaaacagagagacaaagaggaggagacagagagaggaagagacagagacaaagaagaagtcaaagagtgagagagaggaagagacagagagacagagagtcaaagaagtaaagagaggaagagacaaagagggagtcagaaagagaaagacagacaaagaagagagagacagacaagaagtcaaagagagagaaagagggagatagaagtagtaaagaaaaaacagtgtaccctattcctttaaaagccagggtaaatttaaaatgtataattgataattaagggtcttctctgtaaccctataacactccaataccaccttgttgtcagtgtaaacaagggtgtagcccaaaagcactgaggctactgacaacccatagccttcctatcaaaaatccttaacccagcaggtttccaaacagggatctaaatcttaatgaattaccatacaaaggtctgaccagatctaggaggaactcccttcaggacaggaggatagatggttcctcccaggcagttaagggaaaaagacacaatgggtgttcagcaagtgataaggaaactcttgtagaagcagagttaggaaaatttcccagtgattggtctgctcaaacgtgcgagttgtttgcactcagccaaatcttaaagtacttacagaatcaggaaggagctatctataccaattctaagttaatatggactgaacgaggttttcattaatagtaaagaaaaattataatcccaaacttacaaggctttcaactaaagtttgctaaaagttaacagtgtaatatgtattatcctgctaccacacactcttaaaggaattctcagacagtttgcaagaaataacgaaatctatccttactctacaatccgaagtagactctttggcagcagagactctcctaaactgctgaggcctagacctcctcactactgagaaaggaggactctgcaccttcttaggggaagagtgttgtttttaccctaaccagtcagggatagtaagagatgctgccaggcatttacaggaaaaggcttctgaaatcaaacaatgcctttcaaactcttataccaacctctggagttgggtgacatggcttctccactttctaggtccggtagcagccattttgcaattactcacctttgggccctgtatttttaacctccttgtcaaatttgtttcctctaggatcaaggccatcaagctatagatagtcttacaaatggaaccccaaatgaactcaactaacaacttctaccgaggatccctggactgacccactggccctttcactggccgaaagagttcccctctggaggacactacagctgcagggccccttcttcgcccctatccggcaggaagtagctagagtggtcatcgcccaattcctaacagaagttggggtgtcctgtttagaggagggattgagaggtgaagccagctgagcttctgggtcggatgggggcttggagaacttttgtgtctagctaaaggattgtaaattcaccaatcagcgctctgtgtctagctaaaggattgtaaacacaccaatcagcacttggtaaaatcgcaccaatcagcactctgtgtctagctaaaggattgtaaatgcactaatcagcgctctgtaaaatggaccaatcagcaggatgtggatggggccaaataagggaataaaagctggccacctgagctggcagcggcaacctgtttgggtccccttgcacactgtggaagctctgttttttcactcctcacaataaatcttgctgctgctcactctttgggtctgtaccacctttaagagctgtaacactcactgagaaggtatgtggcttcactcctgaagtcagcgagaccacgaacccaccggaaggaagaaactgcagacacatctgaacatccaaaggaagaaactccagacagaccatctttaagagctgtaacactcactgtgaaggtctgtggcttcattcttgaagtcagtgaaaccaagaacccactggaaggaacaaattctggacacacaagttcctaggcttcatccaaaacattaaatcagactctttgaggtagagtaagacacatatttacaagctagttatgcaagttatgatccaggtaaaacactaatcgattgtatccaaaatataagtcttctatcattctgttgtacaaaatgaatgaaatctctaaaatatttctttaggaaccaacacaaagatattccattgtactaagtttgttttctggaaaacaaactctcaggtaaatttgcatgtatgatgtttataagggaattaacttttaattaattatgagaggggagttgaaaagaagtacaatccaggcagagacaacaagcccacagaatatcttaaaaggaatggcttcctgagttctcatgcactgaggctagatgactgggccttgatataactctctccagccccactgaccagccatttgatactatgcttccaggtgatgaatttgtgtgaaatggttgtctttaaatgaagggcaattcctcaggagagactcaagtaattttcactagccagcaacattcctagcatgtggggatgaaggtaattgagaggggagaattcattgcctcaatggttacacatgtaacacttcatagcacccaccacatctataagagctaatatattttttctgggaatttctttactgtcttttctcatttatctttatatatcccttacaagtcaacaaagaaatactgcagtggtggttatagtgactacactgtggttgctggctgtttttttagtgtttaaattaaataatattacccttaggaataaaatgtaaaaccatttttttaaaattcccatcaaaatcaacataacatactgtttgtgttagtaacagaaatatatttaactgcatagataataatgaatagcagtctggattttcaaataaattatttcaagatgatatttactaggttagatacatgtaccctaactcccacccattcacttcctagaaatgtgttttaggtgatgttatttaggtggtaaaatcaggtcaataactcctactgaatccttagatattatgtgttgtacagggaaaaggtagtataggtaaaacttgtgtgagacacactttgttgttttagactagactgtaagttccagctgtgtctgaatgtttgtgtttccccaaaatacatatgctgaaatcctaaccctcaagatggcggtattagaaggttgggaggtgattaggtcatgaggggtgttaacaatagttcccttaataaatgaaaggcctaagagagacccgtcgcacattccactatttgaggacaccactaactgtgagccaaaagcaggacctcctcagacatcgaatctactggtgcctttatcttagaatgccaacctccagaactgtcagaaataaatttttagttttataaatgcctagtttgtggtattttttatggcagtcgatcagactaaaacaaatgtttactctgttgtgatcagatagtttatataacttacctaacacataataggtactctagtaggtcgctcctcctttgacctcagacctttccatttgagaaattttacaactttatttcaaaatgcattccatctactttacaaagtaaaaatacaaaggcctcttatcatgatgtgactattaggctttacaagcctatatcaaagtgtttcatgtaccccataaatatatacacccacacatattaaaaatttaaaaagtgaatgttatacacctccccacttcctttacaaaacttagctcaattccatctggataataagaaaaataggaaactttattgaataatgagtcacttctatgtgtaatttccactgctagtatgagccttcagaagggactggctttaagaattggtacagttcttgactgagaggaacttccaccacctagcagatggggcaatagattacaagggcaattatcactcagagaattgctgataaggtcaaattactgctgtcactttattcttaatctctgtatgcatttttttttctaaaagaaaactgcatatacaattctacagaccaaaaatattgcaaaaaatatgagtttatatgtcctaagagggttccccaattatcacaattgtttcaaatggaaacaatttcatatcccatatgtacatatatataaaaatatatttatgtatgtgtatatatatgcatatatatgcacacacatacacatttctctgcagatgttagtatgtggaaatgtattgctatataatagggacaataattagaactcaaaatctagagtaatgcaactgaaagtcatatcatgcatgtattacaagtaagatactctgcaatgtatacaagagaatgtaatttttaaggaccaaatgtgtgttattaatcaggtatacactctgtaaacactacgtggtataaaattgcttctcaacacaggaaatatttataacctaagtatacagtccaagaagtactttatttctgacacttcataccaaagcaaccagactgacaaataagcattctgagtaaaagcagtgttttaaataacttttgaacccaatgcatgcatgcaaggctgataaatgcaaacccttttacataatactcaaatcatattaaagagatgcttcttgacagagatacacttaaaccattctacatttctcctttttgttctcctgtgtgaaaatgtcaccttaaaagcaattttttaagaaacaagtgctgtttcatttcatgtcttcagatacattgtctgcccatgttttagcgattaggaatttagaggtttttggatgtttattacaactctttgacttatcagtataaatatttatcataccaatcatatttattctttgattatcttgacatggcaaggttttttcaattttatttaaaagagccagctgttttgtatcttatttactcacccatatcattgtttcccgttaaattaacactggcataagccagctgcaagttgcaaggaaatcgcactgaaaacagagctactataaattgtattcgcctctatataccaacaaaaacaaataaaacttttttattaatctctatgactttgttgttgtttaaagcaaatctacattaggaagagttgtcaggaaatttgggaagttatattgtttcctgaaacctgatattgattgatgagagtataccaatgattgcaagttctgagaaaagagttttacacaaaatgaacagcaaaagcttgggcatgagaacaaacttagaatgtccaagggataggaaaaaacgtcctggcagcagagcagcagataggcaggaattgaatcatgtgtactttggtaagccatacacgggcattgagaattttattcttaccacagttggaagtcactggaatattttaagcaagagagtaacttgaactgatttatgcttttaaaagattaccctgattggctgtgtgaaaaataagcgatagggagcaaaagtagaaacagggacaggagatgacagtggcttatgtataagatttcttctaaggatcttgaaagcatcatgaactaacatcacttgggaagtagataaattcattgctgtgtccatagtctgtttatttccctttttttttgtatgtatttgcagaatatgttagtaaacaaagtgaaattcaaggaaatcactattagggctgcctacaaatcaagtcggtttagagctattatagttgagtagtaatattctttcagaaaaaatcttaatcataaagcccaacacttatactatggcttcttaaaagtgaagctgcaaaactgcttgtgaacaatcttacagctatttttataactttttaaagtgttatgtacataatttcttttctgatgacctcattgaattctaaaccatcttttagccacacataagccccaacagttaaaactattaaaatgcattagcatgtccttcattatttgttttaatcaagaagaactgaaataaggaatatgtaacataaatttagttttgctaacgaatacatcagagagaaatatatctccttagagaggaatatattttatctaggtattttttttgaacagtgaagcactttttaaaaaagtaatactgtacacagaattccaaaatataaaacagacaaataaattaaggtacctttatacaaagtcattctatgcagctattataaaaagtaaaatatatatgcattgatagggaagttttaatttattccatataagtaaatattaattgagcattttatatttgagccatcatcctaacagtttgtgataagatagcaaatgatatagggaaagtctctgttttcagatgtttttatattttgaaggaagtagacaaatattaatcaattaagtgaatatgcaagaaatttccacatagtaaactaatctgcagaaaacaaagtcatgaattatctaattcttgagggaacctattacagactgtgttattagggaagccttttttaaggaggcatatatgagggaaaatctaaataactaaaggagccagccataggaaaatagcagaagagaatattctggaaaaaaaaaatggcacacaaagacatttcacctcagccaaagaatatgggatgataaaggacagaaaaaagaccaggaagcaggaggaagagaggtagtagaagcagatgggatgaggcaaatgagacaagatagtgtaggaccttacaggtcatggtagaggaagacacttagatatgattacttaataagaagctatcatagcactgaagcatggaagagatgtgatctaatgtctatttttcaatgccattctgaccagatttcgggcaaacctggtagacacccatagtaagactccaggaaaaaaaaaatttgatggtttgattatatatttgctttaaacatttggcttttcagctgccttgcatccatttccctttaacaatttatctgtttttaaattaatgaccttttctattagacacactttcatcaggggccctgtattgattggtatcttccagagaaacagaaccaataaaatgtgtgcgtatgtatgtatatgtgtatgtttctcagagagagagagcgagagaaagataatttaaggaactggctcatgtgattgtggagttgggcaagttcaaaatctgtaggacaggccagcaggctggagacatagggaggaattgtcatagtttgtgtccaaaaatagtttgccagaatcctcagttttttgagggaggtcagtctttttacttaaagccttcaactgactggatgcagccaaccgatatcatagatccaaagtccagtgatttaatgttaatatcatctgaaagcataccttcacatcaatatctagatatatttgacagatatctgggtaccatgtcttagccaagttaatgcataaaattaactatcccaggctccattccctctggtcaaagggcaagcatgtgattcaagctaggtcaatcagttgctctctccctcaaatttgcactgggttaaaaagacaaagaattacatcctgtctatacagtcatgccaaatcacatgatccatctccaacccctaaaacacataggtatggcttttgttctcaaccttcagctcctaattcctttaaaaagttaccagtatattctgtgaggccacagtgaatcttctaatagtttacttttatgtaggccagagtcatttggcttgtttgaaattaaatatatatatatatacatatatatatatatgtgtgtgtgtgtatatatatatatatatatatatatatatatatatatatacatatatatatatgtgtgtgtgtgtatatatatatatatatatatatatatatatatatatatatatataaaattgcttcagtcaggctccaggtacttggaaagacattcatcaaattaataatggttatcctggggactgggctttgaggattgaggatttctgatttttaatatgtgtctaatctttttaaatgtttcagtataatttataattagcagccaattattttataattaaagtaaatcctgaaaaactttctacattagtgtgtggaaaaacagcacaattgccaaatttatagggcgaagaagtcctatgtttacctagaggggaaactctgaaccaccacagcccaacaggaggctctgtgggacaatttggaaaacattaccataatctattgtttttatatttatttagaaaagaaacaaagggagcaagatacctccccgtctgacatttaaaatttgattcactgatatattttggctcacagtatcaccttgtggcatttggcatctgctgctccccctccccaaagtcataatatactgcataattaattcagcacaagtagtgacaatgccaactctgtttatttaaaaagatacctcgactgttcttttgaataaatagattgcattcctttaaaaatccaaaataatactgaattaattagaagtagtgcaatcagaataaattaggtcctatctacatacaactcagttttaaagctagaaattcaaattaataactaatttgaattagctacttcttcccatgtgtctctgagtaaacaccaagcagacgaaaaatttccattgccaataataatagtaacaatagcaaatattgttaaactcttactatttgctggtaactagttaagcatgcttcataaatcttcttttatagtagtcatgaaaaccacatatctgagctattaccttcattttgtggatgacaagttcaaactgagttttagagacagtaagcaacatacccaacatcacacaagatttaaattcagactctgagtgcttacaaactatcttacgctgtgatggtaaacatctttgcaaattttccctcataattgagtaagccatcagagtttcagaataaatgtgtaggaaaacttataaacatcagggacaagcttaaggacttgacatcttttacttttgtgtgtgtttcatagaaaaaaatagctcaaaggttaatttaaagtaatactttgaacaaactccttaacaagaagagttagacttcatacttgttattcagcagaatagtgactttgttcatacaactaaactaacgaactcaattcctcctttcgactgtttcttttttttgcctccttaatagttattttatacctgtttcttattatttatttattccactaaaaatttcaatgtcttcacattatctataattggtgctatggtatattacagttgaatatagttgaacctgttcaaatacattttgaccaatgataaggagaaccaaggattcctttgctttcatattacttcacacatgactttttaaaaaatttactttaatttctgggttacatgtgcagaacgtgcaggtttgtaacataggtatacacatgccatggtggtttgctgcacccatcaacccataatctacattaggtatttctcctaatgctatccctcccctattccccgacccccagacaggcccccatgtcacacaccacttttagaatcacaatacaatttcacattcaggacaatacttgctgaattttagtttgtgtttgtgtgcgattgttgatgggaagaacaaaatggcagtcacatcatatgttgactctagatgtgttatttatcatttgtttcttcaaaatattttgacaaacgatcttcgcattaaaaggctgtgggcagtttgggagctaccacctgtttccctcttcattgatcactttgctggccccaaaacatatccacagaaaaaattttgaaagtgattggccaagggactcagtgaggatatactttaatatttagaacactattaaaaacaaaaggagacattattaacaatatgctgggacaagaattataacctgggactttctatggcaaatgggatatatgattacttgatctagactgtataaaataaataatatatttggataatctacaattacaataagtatttatacacacaaacatatatatacgtacatacacacacacacacacacacacacacacacacacacttcacatatgtacctttacaaccaatatactttaattgagactgagaggacaagagccatgattattcatatttatattcaatgacttattacataataaacatattttgaaaatttgatgagttaattcaattcaaaatatgcaaaaaatatcaggctgggcacggtggctcatgcctataatcccagaactttgggaggccaaggcaggtagatcatctgaggtcaggagttcgagatcagcctgaccaacatggtgaaaccctgtctcaactgaaaaaatacaaaaattagccgggtgtggtggcacatgctggtagtctcagctacttgggaggctgagagaggagaatcacttgaacacaggaggcataggttgcagtgagccaagattgtgtcactgcactgccttggtgacaaagtaagactccatctcaaaaaaagaaaaaaaaaatactgtatatctgctatgtgaagccaatgggtttcaagttaggatataatgacaaagaagtttaaagaattcatagcgtagtgaaagaaaaacattcatagtaaatgaacacactgtaatgaagagtttaatatttatagtaggaataaatgggatcacaaagagaaactattagttttgaggatctatcattttaggttaactgatatgaaccttcaataacaaatatgtgcttaacatatgaaacagagagaaagtagggtaattctcagagttgttcagggtcatatgtgatgttctgtgtgcctagacaagttgtactatgtgtgttagaagagatgagactggaaagtggtcagatataagttactttgaatgataagataaaagccgtggaattcatttggtgtatgatggaaaacactgaacctttttaaacaccaaaaaatcagatcagcattgtattgaaaaacaaaaacaaaaacaactttggctttattgtgatggtggttagaggagtgagagactggaggccggatgccgagtttagagtatgtctttaaatagatgttctgacagtgtaaatagacaggtgtcaaacagatttgagtaagagtatataggtaatgcagaaaatggctttggagattgattgagtttggaacggaggtcattgaagtctaggttcaaatcaataatgaccacaggagtaacaatacatagtaagtatggatacattagaattggatagaaagaataatgaggcatctgccagaaacacagttaaaaatatccagaaaaagacgagaaattcaaacttggaactcaagacagatttcaagttagaagacttatctacaacaaatacataatccctatttgaggaaaaatagaactctatataggtttgctcaactcaatcttagtaaaacaataagggagaaaaaaagaattacaaaagagagaagccttggaactctttaaaatttaatcataattttaaaataaatttcaaaataaataaaagtgatcaaagatttaagaggcaaaatccaaggccaccaagggaatgagaaaaaacggtacttccataaaaaagcaagagaggagagatttcccagactgtaatatatttaatgtgaggctatgccaagaagaaatgataagtgttgtagatcactgaaaatcatcattacttttctgataactgagaaagcttccccggagggagagggtttcatagataaaccagagaagctgtttttgacatgaaagctagattttttaagacaaagattgaagttgagatgtttgtcactagaaattattgggatccaatccaatggttttaaacagggggagagaaaaagatgaccatgttcagtgagcaactgatgttgaaatactgaaaaccacatggtgcaataattaaaggaaggtatacacagtaaacgcatagaaaatacgttaatatatcattcatttttctgtccagggataaataacactgcaaaagaaaaaacagccaaccaatcaagcaaacacataaatgtatgctactgttcaattgaaaaaaatgcataaggatttatcatggttttatctgtgcttcattagaaaataaagccaaggattttatactccaaattctacagacttttttcataataccagaaaaccttaactttacagacataataactttaaaagagttggaaattaagaataaacatacataataatatatctgggcaataatttatttcatcctacttgcctagcatcctcaacgtagtttggcatacattaaggtcctatagaaatttatcaaattaatactaaattagcagagtactatgaattgctttctacctttgtaacaccagatgtatatatttatgtgttcaatataatattaatcttagtgtttgtgaaaacattaatttgccaaagagagttgtttatattagaaaaccgtgtaatctacatttataaaatcagtgtatttctaaacaagtgactttaaattttgatataaagcgatttttatttttattatatcatagttcatgagataaatttattaatagactatatttttaaaagtttttctgaactgacaaattctgcatgtattataatggggttaggaatggtttctcaagtcaagaataccaccaaagtaaggaaaatttcacatcaacataggtgaacaggtggcaagtcttccaaaatttgaagaattctttcaagaaaggatcagcaagtatgtaattagagtcaacatgttctgtttagctgacattaatggttagctttcactctggagagcaagatcttattgaaatttcatgaaattttagcagaatatataaaggaaaatagaaaaagagacaatcaaaaagaataaaagtacagacataaacacagtaatttgaatgtgaagctcaaaaactaactccagtttttatacctagtgttctagaatggattcaaaataacaatatacataacaatgtacataaaaacctgatgccagtactaaggatgattttattttctaaagattgccacaataacattttcttttccatatgctcttcttataatgtgacttggacacccctcatatagggaggtggagtatgtttctaccccttgaaactggcagagatttgactacaacagaactgacccttcaaattccatagctaatttatgaaaatttctgcctaattctcttgggaagcttgttgtgacaacccactgtcttgctgtgaggaagccccaacagcctataagaggcttcagtggggtgaaaatgaagcctcagtcttcaatcctggatgagcaccagccaacagccaaaatcaacttggtagccatctaagttaatcattatgaaagtggcacccagccctcagttaaagtgccacagctgatgctgcatggagcaaagataagatgttttctcaagtcttgctaaaattgcagcttagtgagcaaattaaatgattgtagtttgagcccactaagttttggtggcctgttatacggtgactgataatctgaccaagtgcctaggcttacaagtaaatatatctatatttttgtacatgaaataaaaaaataaatatttgccataattacttaaatgtataaatcttaaattctcattttttcaaagtatgttaaggaatggctcaatctgttaaaaatgataaaaggatcaagattgatcattccagaatttcttccataatatttaattcaaaaagcaaggttttaaaagaaaataaaagagtaattgttcaaaaaaatatttattgatcttcagttaaagacctcctttttttactggcaagaatccactatccttaggatctttcatgctctttgcccaaacactactttacaaaggattcagagcataaaaaatttcctgacttatttcttcaccattagttcattattctccttatgttaggatatgcaatatttaatattggactgggtttgtcatctgaagactgaataagttttatccttggactagttctactttgagtactgatactcaaaatatgaatattatagtacaacaagggagatagtgaggcattctgaccaaaaatttgcccatactctctgaaaatacttttggatataaatatttttcaacaactatgtccacctacagagtgaatctccaacttaacccaggctgccagagccagaaaaaacctgctatcaatttttgcatgtagagctaggactcaaatgtatcttaattttatttactcttcctaaattgtatctatatacttaaactgtctaccagaaacgtttttgtgtatattcaacacatgcaaccagttaatatttgtgcagagcttagcatagttcattacgaacagaacattctatacaacctctagacattatgatcacttacgttattaccccaaattgaaagtataatctggtctctagcattaaactgcataggaatgagagagatgctcagtctgtaatctggagaggaaaggaaggtcaatgattctttgtaaaattaagtttgtacactctgcttttcaagcagcagtctctatcttcctttactttcctcaatgaactaactactagtaaacagtcatcagactgactcattgaattggattattgcggtttcaatgtataccttctcttggggtcccactggtacactagctgaatctattaactcggaaacataaattaatactaaaaatatatttttctttttccttttttatatttaaaaggattttaattggaagtacacacacacacacacacacacacacacacacacgcaatacagagtgccaaatttgtatggggatgattgaaaaagattattatcaagtattaaatatttgtttcagcatatttgttttttcactgttgtctttccgaatagaaattttcgaatgaaacaaaaatgcacattttaataccagcccaatatacttgatccttacatgtttaaatttcatgtgcaaaaaatgattagtcatagagcaaacccaccctcttgtagaaattttaaaagattttaatgccagcgtaatatacttgaaccttacatgcttaaatttcatgcacaaacaatgattagtcatggagcaaacccaccctcttgtagatattttaaaagataaataaaaatgaaacttttttaaaaaaagagttatattttaggttcaggggtccatatgcaggtttgttacataggtgaagtcgtgtcatgggaggttgttgtatagattattgcgtcacccagttagtaagcccagtacccaatagtcatcttttctgctcctctgtctcctcctaccttccaacctcaaatagacttcagggtctgttgttctcttccttctgttcatgagttctcatcatttacctcccacttatatgtgagaatatgcggtatttggttttctgttcctgtgttagtttgctaaggaaattagcctcccactccatctatgttcccgcaaaagacaagacctcattattttttatagctgtatagtattccatgtggtatatgtacatcattttctttatccaatctgtcattcatgggcatttagattgactccatgtctttgctattgtgaatagtgctgccatgaacattcatgtgcatgtgtctttatggcagaatgatttatattcctctgggtatattcccagtaataggactgctggatcaaatgggagttcttcttttagctctttgagaaattgccacatggctttccacatggttgaactaatttatactcccaccaacagtgtataagtgttcccttttctctgcaaccttgccagcatctgttattttttgactttttaataatagtcattttgactgactgtgcaatggtttctcattgtggttttgatttgcatttctctaacgattagtgacatttaactgtttttcatttttttattggccacatgtatgtattcttttgaaaagtgttcatgtccaaaagaaaacactttttgatgtttttatttaattcttgtaattttaaattcctcatagatgctggatattagacctctgtcagatgcatagtttgcaaatattttctcccgttctgtaggtggtctgttcactctgttgatagtttattaagctgtgcagaagctcttaagtttaattagatcccatttgtcaatgtttgcttttgttgcaattgctgttggttctttgttacaaaatctttgcctgtgcctttgtcctgaatagtattgcctaggtggtcctccagggtttttctagtttggagttttacatttaagtctttaatccatcttgagttgatttttggttatggtataaggaggggggggtccagcttcaatcttcatatggctagccagttctcccagcaccatttactgaataggaagtctttttgccactacttttgtcagctttgtcgaagggcagatggcagtaggtgtgcagccttataaaaattatgtttgtcatcattacttttaccagtcctttcaagtaaaatttttatgttcaccatctttaatagtttgtgtgttttttttgtttgtttgtttgtttttgtttttgttttttgggttttgtttttttttttggctgggattcaacaaaataacataatggcatataactttaggtattctacatctattttgtccagtcaagttctgattagcttttttgcctgcaaaaatacttcatttggctgaaaacatatttttatccaatgcacataactatttatttttctctccagctgttttttttattcatgcaagttaactggaccagtgatcattgctgtgagtagactcaaaagtgattctcagctattttagatctgctgtgagaaaaaccaatagatgtattaatattataacattggataagcactctggctttacatttaggaggcattcctgttctattcctcaaaatctcaaatagaggaccctcagaacttcagttctcatgtattttgaggaaaaaaagtcaagtagcttccaacaaattctaacactttgagccattttgggaacccagagagctgattgctttccagggaaatagcaaaaatactggttaaatggttaaatcctagaccacggaatttttaaaaacagaatatgtgtatacacacacacacacacacacacacacacacacacacacacacacacaaatacaccttttaggggagaaattgatatttttgcctcagcaggatatccatttgccttaaaattcttattcttaggtatgtacatcaatcatctggggaggtccaagctgtgaaatccaaactgacagaaatttatagctccattagcatttatcaaaaatacaggattaagtgtagaaaatatgtattcatgcttcacctttctatatctttactttaagaggtaagtatttgtattcagtatttgttagctcctaccttcaaacggccaaacataatctccaataacatttcagaattctactgggccaaaaatgtatcctattgacctgtgtgtcctctgacttacgactgcatgtttaaatatgaatttaagaaaatgctgcactgattatttggagtttttcagaatggctagtgaattccttggtgatttattggtaaaaaaataaaataaaataaccatgttggactgttgtttcataacatactttctatttggaaattatataattactctttgtgttaaaaatgtattcatactccctgaaaatagtttcggacataaatatttttcaatgtgcatatactgagttttgctattataaattatatgtctacaaaatacttgaacatgatcccattgggttttaaaacatgcaaataaatggagaaagataagagtatatttaccggagttctcaactcaggtatggcagcttgataagtgagtggacggcaatcacgagtgtttggcacaaggacacaaggaagaaacattggacccaagtcatctccatccagaacatccactgtgagagtggtggtggtggttcgcctctcattcagattttgggcacggtcctgttagggagaaaaacaaacaacaggtagtttatagaaattaggcacaatagccaggagcagtggcccatacctgtaatcccagaactttgggaggccaaggtgggtggatcacttgaggtcaggggtttgataccagcctggcaaacatggtgaaaccccgtctccactaaaaatacaaaaatctgggtgtggtggcaggagcctgtagtcccagctacttgagaggctgaggcaggaggatcgcttgaacttgggaagcagaagttgcagtgagccaagatcacgccactgcactccagcctgggcgacagagtgagactcagtctcaaaaaacaacaacaaaaaagaaattaggcacaatgtagacttagttttcattgaaaaaaaaaagattggtaaattaacttgcttaaaccaacagttttaagtggttgagtcaggatgtaaactgagatccaattgtcttcaaagcaactttcttgaaagtatgttacagtagttaagcttttgtatgttaggcctttacctaacagttcacattactagacagcctaaccataaaggtcactctcatctcattagagcatttactttagaaaccttgtaattgtaaattccttctctgcgcctctgaggtgttaatcttttataagctgcttgtcagttctacaaaccaggcccatctttttcatgccctggggggccatctctttgaaatgtaatagtcaaggaagaagcccgtatttcccagtttctgtgggaggttaggagcctgacttcctttggaggcttgctccaatttctaaaactactttctgtcatgaaaattcaaggaaatttattttcctttgggaatgccaattagtaaacacatctggtctgtgattcccccacacccaagtccactggagtgtttaacagctctccagccattttttctattagagatcagttcagatctagtctgtattctggtctctcttctctattgcaatagctgtgaatacagtcttccttatcatttaactttgtctagtgcaattttgctgtaggaatacattgttactaactaaaatccaaagtttctttagatttccttagtttttacttaatgtcagttttctgtttcaggatcccaatcaggataccagtttgcatttagtcataatggttccttaggctcattttggctgtgacaagttctcagacttttgtttttgatgacattgacaattttgagcactggatattttgcagaatgtcccttaatgggtgtttatctggtgttttcctcaagattcaactgcggttatgtgatgtatgtaggaaaaccacaagtcaactgctattttgacatatttatcaaaagtatatgattaatatgacttatcactgttgttaacttcatcacctggctgaggctgtatctagtcagttttctcaactataaatttcctctttcttgtttccctttcatttctttggaaggaaatcatgatggacagcacacacttaaagaatgggtagtaattttattagaaatgtaaattgtttatatttatctgaagaatgtttgtcataggacagaagaaaataatattggacctaagtcatttccatgaagaacatccattgtcaagggtggtggtggtagcatcattcattatgacagaatctggaaatgtttttactttcacagcatttagttattattttgaagaactattatgcttttctgcctttttgaattctattttgtacaacattgacaagtatacttgcatgcatgttcatgtagcactattcacaacagacaaaacttggcaaaagcccacatatttatcaatgaataaatggataaacagattgtggtatgtacacacaatagcatatgattcaagcataaaaagaaatgaagtactgatatatacaacaacatgaatgagccttgaaaacatcatgttttcaaataaagaagccagacaaaaaataaggtcacatattatacgatccatttatatgcaatatctggcagcagtaaacatattggtggctacaaggagctggggaggggatatggaaagcaactgcatgagtggtgccagctctttttggagtgattaaaatgtttgggaactggatagaggcggtggttgcacaatactgtgagtgtaccaaatgccattgaattgttcactttaaaatggctaatcttattttgctaatttatgttaaataatttttaaaagtaattatactaacagacctgtatttttttttttttgttcataaaatgtcttcctttgtgacagttcccagacattaatatttgccttccaattaaaaaaaaagtccctcttgttaaacatggttaatagtacattttggttaagctcattcccagtctggttgctcataaaaacttgtaaagcaatgcttgagggtaaagttttaggaaacacgaatttctgttggtggaattttgtcagtacaaccttgtctagaatgtaataactctgtggttccaggattctttgatatttttatacagtataagacagactgcgataaaattatagcttaaaaaaacacaaaatgtttaaattttcaaagtttcggaactcactcagatccctagaggcactataaagattattcaaacctaaagacatttgagattcaacaaacagaaagaagtcttttctgaacttcttttatgtcactaaaagcagatacttatgagagtgaggctgccatgaattccctctgccaagaaagtttatgaaaatgaagaaaaaacaaggaaatctattcttacctacataaacatgatcacaagctattttaatctcccctttgactcctagaaacctagtttttcttcccttagaagcctcctccctctcattgtgttaaatatatacaccttcttctttagctgtttaaggagctgtgtatatgcactcccatatgtatatcaacctctaggccagttgaaaagtagagtaggagcaacatgtggcatgtgagataattttggtggttcacaaattaactttataaattattcttaagatgtatgaattttgaacatgtagaaaaatattaatttaaaataagcgtatgtgtatattttaaattttaaaaaaaaatagctcatcaaacttgccacttttttaatactgatcttttatttaattgggttatagctatgtctataatatatgaattaatagacaaatgatgtaatgatttgttcagtcagcatatcctgagtagcttccaaggggcagattccaatacactgcttctgacggtcttaaaaaaatgatgaggacatgtttcctcatcccattattaagagagtcatttagtactgaaaattactaatgttaagataatgtgacctcataaagattagtaggttatattttcacatatatttccctttgtgttgcatcatccagtgttttaaatcattaagtaatctcatcttccatatttctaaagttatattaaagtttaagaactaaaacaaatctttaaatttctaaatatatatatataaactggaagcttctttaataggggtggtaaacttttgttacatttattaatgattttacatttgacatttttctcaataacaaataagttaataaaatgacatatttaatatgtatttgtaaatttacttgtggcactggagttaatatttgaaaatttttttatttataaaatatttatttatttatttatttattttagaaatgagaatctcactacattgcctatactgacttcaaaatcctgggctcaagtaatcctcgcacctcagccttctgagtagctaggactataggtatgtgcctggctttaacccaccatttaaaataatgattgcttatgaagttttaaaagattgaattaatctaaatttaatttataaaaatagtaaatagataataaatattaaatatttataatattttatgtgatacatgaatgtagcatgcagatataaacacacatatatatgcatatatacacatacatgcatataaatgccagaggcaatatttctacccttccatgtcactcagccttctttatatgtaatcatcaaatcactataataaacaaatttgaattttttaatgttatgttttctttcagtctgtcagcatcaaatctctcactattatctgcttctttgggtcattgtcactactccatagaatagatactggtgtgttaaagatagtgtatttacaggaagtgtataccaaaatacataataggagttttttctcatattggggaaagatattgcttacaaagtgttgagctctaaaatttgtatttttaagtgggaaataaaaataatcctggcaaaatgattgtgagcagagatgtagcaacaaaatctactaacagtttccacacgtgggaattctcccacattttatcaccaacacatatcacataggaaaatatataaaaatatgtctcatgcacactcataacttgtgagcccataatggtaatgctaattcatgatgttctcccaatttggaatcagatttgatcttaaaatatccatttaaaaaataatccttcagcaattgagataaaaatcaaaacaaaaacaacaaaaacagaaaaaacaaaacaacctacacttttgatctttatagtaatatactactgctcaaggctcttctgagtaaatgaaataacattctaaattgtgagtggtaaaaaataaaaaataactatttctataaacattccatataatttaattatgttttcatttacgttatgtgataatctaatatatattaaaatccacaaagaagatctcctttcttccctttcccattttcatctgcatttctcttcttttttaaaaaataagaatatatatttaacttcaattatttaaaaataacaggatattacattaagttaggaaactgtgattctagttggcaagcaagaatatcttttaaaaagttaaacaagttcaaccagtactctgaacagaattgtgtctcctcaacctcaagctagaaaatctagagtaaagtgatatgtttctggaaacacataatgttccaagatcgaatcaggaaactattgaaaccctgaacagatgaatattaagctgtgatattaaattagtaataagaaacttaccaaccaaaaaaagcactggaccagatagacacacagctgaattctaccagacatacaaaaattgactcaagatgaattaaagatttaaatgtaatacctcaagctataaaaatcctagaggaaaacctattaaaactcttcttgacattggctttagcaaggatttcgtaatgatgatatcctgaaaagcaattgcaacaaaaacaaaaactgacaagtagcacctaaactaaagagcttcggcacactaaaataaactgtcaatacagtaaacagaaaatggaaagaatgggagaaaagctatgcaaactatgcatctgacaaaggtctaatattcagaatctataaggaacttaaacaatttaagaagcaaaagacaaacaatcccattaaaataggggcaagggacatgaacagacacttctcaaaataagacatacatgcagccaacaaatatatgaaaacatgctcatcagcatttatcatcagggaaatgcaaatcaaaaccataatgagatatcatctcataccagttagaatggctattattaaaaagtcaaaaaattacatatactggtgaggctgcagagaaaaggaaatggttatatgctgttggtgggtatgtaaattatttcagacactgtggaaagcagtttgaagatttctcaaagaatttaaaaccaagctaccattcaacctaccaaccccattactgggtatatacacaaagaaaaatagtgcattctaccaaaaagacacatgcatgtctacattaattgccatgctattcacaatagcaaaaaacatggaatcaacctaggtgcccatcaatagtggattgcataaagaaaatgtggtgcatatacaccacggaatactacaaagccatagaaaagaatgaaatcatgtcctttgaagcaacatggatgaagctggaggccataatcctaagtgaattaatgcagcaacagaaaactaaatactacataatatcagtttttcaatgggagctaaacaccaagtgcccagggaaataaacctgggaacagtagactgtgaactgctggggcaaggagagagaatggatcaaaaaactacccattgagtactatgctgaccacctgagtgcaatacacccatgcaacaaacctacatatgtactccctgtgcttaaaataaaagttgaggaaaaaaataatgcttctatgaacattaaccagaggaagttgggtattctattgtcttgtaaacattttttgtttgagatatttgcctaatatttcttattttttatgcaaaccagtagacagaattatattatcatttatagccccaaatgctcatgtatctttagtagccaaacactcagtaaatattaggtcccataaaccatcacctgctatcctcccatttcactctcactcctcagaaaatgcccaagaaacttgcagagttaaaacaatggggttacaattaacactaattccacacatcagtaggaagcagaagtgagggaaggtcagggtagaggttatttctgaaaagttgtttacaaggttgaaatataaaatatagaaaattaattttacctatacaaacacatatgtttgcaatgcttacacattttatttgaatatttctgtccataaagataaaaaattgagctaataaagaaatagtaatattataattttaggaattatatcttgttaggaaagatagctagcatcccttctctagattttgctatttgagaaatatacaacacccttgctattcataaaataatttagaaattataaattattcttgccatgattctaaattaaatttaggccgggcacagtggttcatgcctgtaatcccagaacattggaaggccaaggtgggctgatcacttgaagttgttaatggtttcagaccagcctgtccagcacagtgaaactccgtttctactaaaaatacaaaaaattagctgggagtggtggcacatgcctgtaataccaactactcgggaggctgagttaggagaatcatgaacacgagaggcgaaggctgcagtgaaccgagatcacccccctgcactacagcctgggtgacagagcaaaaccccatctcaaaataaataaataaattataaaataagtaaatataaacttttttctttctggtaattaagaaatcttgattacaaaagtgttcttatatatttcactcaggataacaataatataaaagagagtttgctttgaagaaaaatgatatgtaaagagattactttgattctatgtgaattagggtaacatatcaaagttgaggttataataatatgtagtaaatttcaacaaaaagaaaacccatttgatctttctagatctacccccaaaatttttgtctggaattaatcattccttcattatgtatttatatttgaagtcaatagcatgggtgacaatattgcaaatattctcaaaaaaatatgtgacagggttttctaatatgggtcagtcaaaactcaattaccttaattacggatcataacatgtaaacacggataaaaagaaacctccaaactacatgtaatttgaaggattctcttcgaaaatcaaatatttttaacataagcaaaaccaggtcaaagctgggtaatgttcaataatttgtcatgatacctgtaattattcttttagaggccatatactttaaagtcaaaattgattgctcatatcttaattctccttatgacttcaagataatatattggtgcttaatgtacatgacttacattgtgcataccaccaacacaatataaaaaaccactgccaggtgcagtggctcatgcgtgtaatcccaacactttgggaggctgaggtgagtgaattgcttgaggccatgagtttgagaccagcctgaccaacatgctgaaacctcgtttctactacacatccaaaaattagctgggtatggttgcacgcatctgtaatcccagctactcaggaggctgaggcacgagaatagcttgaacatgggaggctgaggttgcagtaagctgagatcatgccactgcactctagcctgggcaacatagcaatactctcctcccctcccaaaaagaaaatccaggtgtggtggtacgtttgtggtcccagctagttgggaggctgaggcatgagaatcacttaaaccccgtaggcggaggttgcagtgagctgagatcgcaccactgtacttcagcctgggtgacagagcaagactgtctcaaaataaataaataaataagcaaacaaacaaacaagataaatgtaaaaaaaatggaggtacattttagatatatggatatcattatcatatacaaacaaagatatgttagacttatgttactattggtatatacaaaacagttaatgattaacaaccagctatcagataagtagccctgatttgtagcactggcactttccatactgtaaatgctcccagcatggctgcaaatgtgagatcactgaactcagagtttgaaagagaaacccacaattggccctcaagcaagtctcagctgactttccacctccaacaacccacagttttaagttacagatttaaaatgttgtgaaaatgagcatccttctttatcatttgtggaagtgtgatatgtcacaacactttgaaaaataatatagcattatctactaagattaaaaagtatgtgaatatatatgtacaaatacacatacacatatacacatatatatgcatacatataattttctcaaagcaattccatttttaattactgatttttaaacagtaaagtaccagtattttagtgatttatataatactgtaataatgtctcaatatatttcaagcattagtctaagtacttttttgtttgctaactagctaattgtaaccagaacaatgtggtatgttttattaatatacccattttactggttaggaaattaacatacaaagcatgccccaaatcacacagccagtaaatggctgaactgagatttgaactcaggtgacataattcactacactcactgcctctcttgaacatcatgagggtagatatcaatttggtgccaaaaacaaatgatcaaataaacaaaaacggagtattgttgaatcaatggtgatccattattattatcttacattatgtagctattaaaattatttgttcttaaaacttttaaaaatgcttaaaatgttataactttctatatttaacatttcattgtgtactgtatgacttaagtttataacaaaaactgttattgcatttaaattcaaatgttcattcgacttcttcctaatgctattccttccttttgatgattcacatatgtacttctgttttataactttatccctgaaatgctaaaaacttgtcactacctcagtgatgagtagtccatcatgttggatagaagttgttccagatgtctttataaatattttaaaactagacaccaattcagaatcttttaccttgcatttctattaaaaaattatatctttttaattgcatgataaaaaaactagcttacaaataccttccacagcaatctgacttcataaaaaagacattctaccttttcttcacatcttcagttaaatagaaaaaagaattttctgtgtttttgaaaaactctgagtggccctccctaatacattttacttttccccatatctacagttttcactctgctctatgttacatgacattaaaatatatacacacatacagacacacacataatacatataacatcttataatatataattataatatataaaataataaatcatttttaaaatctgaagaaatataaataaaagcttccaaacttagcttcaaaaattagatctatatgtctatctacatatttctatctacatatccctaattatatatctatctaggtatctatctatacacatacacattctgtgtcaggtgatatatctctaagaaaggcaagaaaatgacaagtttgtggcacattttttcatgttaacttcttcagaacagctaattgaggttattttccttttagcatcccctgctatctatctgttctgctgtatgagcaagattacaacgcttaggagtcattaaaggcacaggatggcttcagagtatagctgctttaaaaaagaaaaggctattaatttagagcagttttaggtttatagaaaaattgagaggaaggtatatacaccatgtctccacacgtgcacatcctccccacttacaacatccctaatcaaagttgtacattggttacaattgatgaatctacattgaacaatgataatcaccaaagttcatcctttacattaaagatcaccgttggtgttgtacattctatgggaatggacaaatgtataatgatatctatccaacttcatggtatcatccagagtattttcactgacctaaaaatatttcatgatccttctattaatccctttctacctgcctttaccaccatatccctgacatccactgatctttatactatttccccagctttgcctttaccagaatgttatatattggaatcatccagtatgtagccttttcttaatggtttattttgcttataagtatgcattcaagatttctccatactttttatatctttatgcctcatttcttaacggttatttcaaaaacgtaagcttgtcacttaatatgggactttttatgtgacctccccttctagcttttttctcaaggggtactcccattcatcttgctaagaaaagaaaaatgttttcaggtcatcagtgtgcccagtctcaggatatgaactatacatagtataattcagaagtgaataccgcatatccctttgacacatatggacttcctcaaccttcgttcctattatgctgacacaggtgatacaagtctagaaggagatgttggatgggagaaaactctgaagagagtatcttcccagataaaagaaggaagaatcaataaacgtaaaagaaatcctagttttgctaccctttctgcctgttgcattcagacttgaaatgcagttgtgatgcttatggccatggtacacaaatacctcccagctgataaggcattgggaaaataaccacattccagagaagagggaagtataaggatggaaggaacctaagtccctggtgatataattgaactgtcaaaccaaacattgagctgcataattccagaaattttattaaacttccactaataataactataataaatgtctatgttttataagcatataagcatgtctatgttatataagcatgtaaggatatctatgttttataagtatataaaccatgtctgtgttttacaagcatatgtttggatgtcctgttattgttatctacatacattagcataaacttcagttatgggaatattagctgatatctagtgaacaattactcaataaatgatagccatgaggaagaacacgaccaattaggcaatgattctttgcctttagtgtaccttagaattccctgaagagctaattaaaaatgcagatattccacttccatcatctgagatttttattcagaacatctgaggtagggtccagaaatatgtatatttaatacacacccaaggtgattctgctgctgttaatttgcaggatcctactttgaaaaatatttcagtatagtctaaaaaggttggataatggataatacatatgaataatttagaggtcaaagaatacagtgaataaaaacaacctattctatccctttctccatctataagagtattatatataaacaccaagggcaggagtgccctgatgaagaagtgagtggcacagagctctccaagagtatctgatacattttggatgagttttttacttcataaattcacagaagaaatttaaaagaaattgaatactcacattagcttggattatgacaaagtagcgagtcttatcttcatagttgagcctcttccttaacactatatttccagtcaacattaggggaatttcaaaggtgtcattggatgtctgcaaatattaaagatacagacttcagattatttgaatgtaagatgaattaataactcaatattttggattaatcctcttggaagttagagatgacatgcttatcatctgaaaatagaatgactataagcttcagagtcaatattgttatcatacttccaaacatttaattttgatcaatgggtttccccagagtcctttggtaataataaccagaaaatttgtttcttgtcatagtttttaatatattactagtattattcatcaacagtcttggaatagttctaaatcaaagtccaggtatctgaaaaacttccctgttaccacattatcttttcactgtgttctttaacaccaaagcattcaaacactgaaatctgttatttctacatagtatcaattgtcaacattgatatccattctgtattttaagtatttttaagtattatctggcattaaatacaaaaaaaaaaatacagttacgagtcacttagtgatgaggtacattccgagaaatgtgttgttaggtgatttttgtcattgtgtgactattatagagtgtagattcacaaacctaaaatggtacagcctactacatactaggacaagtgatatagcctatggctcctaggctacaaacctgtacagcatgtcactgtactgaatgctataggcaattgtaacacaatggtcagtattttctctataaatgtaatctaaacatagaaaaggtatagtagaaatacaacattataattttatgagaccaccatttgctatgtgatatatcattgaccaaaatgtcattatgcagagcatgactgcgtgaacttgaatcagttcattattgtggaaaaaaaaatccaggttatatatcatttttttcttttaggttccacaacttctgctcattagttaagttctctgccctgtctaggactgagttttttcctggtaacatggaagtcataagggcaacactagtgctctggtataagcagccctcagtgtaactgtattcacaccttaagggagtataatttataagataaatctcttattcttaagaagaccttatgtcacttttgtattttagtgccattttaaagaatgataaaattgtttctagtaggctcaataactcagtgttattttgttcactgaaattgtcttgtggttgttcagttgccttgtgtatttgtgcttgtgatttttttgtgaaatatttagtttgaatctgcattagattgctgcaaaaggaaggaaagagagggaaagaaaaatgagaggaaaaggcaaggggaaggagaagagaaagggaaggggaagtgtggaagaagaaaaaaactgtgtatgtgagagagaaacagagagagagaggaagagagagagagtgttcacaccctcaacttagtgtaagtgtattcctaagagtcacataagaagttaaactcaatgaaaaaaaaaaagctgattcaaatctctcagctcaggctcaatcaatgaaatgtgtgtagtttagccttccatgtctagagctgtgatctgtctcctttctttctttctttgtctctctatctctctttctctcggggatgcataaagacacacacactgtacattttgcagaattaatatatatttttaaatgattcattctgtgctcctcatgtaatgggccttgcaaatcgttcttggatgcagtcatttaaaagtaacaatttaaaatataaatacagaaaatgaaaatgaacaacacaattaaaaacagacatttgacattttccctaattttttgcctattcaactttgcttatacctatgagtggggctggcattatgacacaggagtgtgaaaatgattgaatctaaacatgtaagttgaatatgggcaaaaccttagttaataattgctgtttacactgttaaacttatcctaatgtgttgttatgaggttattacattttagtgactcaataatatagaaatatatattggtttctagcataaatatggaagatactgtggtcttaccacaaaactaccacatctctggactcagaaccccaaattagctcacatatctggtgacattgtgcctcagaggaggctatgtctctaaatgagatgagtcttgaatagtctagcttaaaaacagtaattccattctcttttaccaggaagtattttgcaaatgtacatgtgattccattttgagtaatgaaaaaatttctcttaattgcaaagatagagagaagctaaaaatcccttttcaggttatagaagtttctgtcaggatataaaatttagaacttcagcagccatttggggactattgataaaattaattacggagaaatagctaacatgctagtgatagcagagtataaaataaaaagagcccggatctgtgttgtctttgagttgctgagcaaatcttgatattaccccatctctgaaaaacttattatgatagataataaattacctttttggttaaatcatctttaatttagttttttacatatatataatatatatataatctatattatatattattatatataatataatataatctatattacatattattatatataatataatataatctatattatatattattatatataatataatataatctatattatatatataatatatatatagtaaattttctgcagctgaaagcactttgatacatgattattcctgtctctatgtgtttacactgtaggcctctctcttctccaaacaggccatggctcttcacacctgatatttgctcttatttttctcttgcttaaatatcccatcacttatttctctgtgtactaatctttgcaaactttactcagtgaaacctcttaaatgtaatttagacttaagtctttgatgtgatctcacattattttttccaaaaaacacttatttgggatcttctgttttgcttgacagattcctcaagggtctcagtctgtgatgcagaaataacctatccttaaatgtctagctaagcaacttaatgaatctttgcaatactttttttgttgttgacagttttcattggacgtttgtagaattattaaaaataatagttattagtgactttattgatcttcagagcactttcaattgcactgaattcttatcatcttaaatctatcctttagagattttatagattcttagattttaattttactttttatatgtatgtatttatttatttatttattgagatggatgcagtcttgctctgtcatccaggcttgagtgcagtggtgcaatctcagctcactgcaacctctgcctcctgggttcaagcgattctcctgcctcagcctctgagtagataggactacaggcatgtgccaccacatctggctaatttttattttttacttttagtagagatggggttttaacatgttggccagtctggtctcgaactcctgacctcaagggtatgcccaccttgcctcccaaagttctgggattaaagatgtgagccaccatccctggcctagattttcattttgttagcacttgtattctataaaatataagaataggatatactttatcatcaatggtgcttctgaaatgttgcatattgaaagccactgtattaaatttaatttattaattaagcaattattgagtattcattctgtctctaaaatgtagaataataatcaagaaaattagaagcaaaatatagatatctttggtatctttatgatagtcttctttttcctctagtaaaaagaatactggattagatcaaccctaagtaaaagtcttgctttaatgatatttctgaagtgtttacctaaaaagtttaaaaaaaaaaaagctaaattaagcaagggaaaaaagtagattttttaataaataaatacatgataaagccatgaaaaaaacaaaacaatacttagaacattcttaaagtttagaatgcacaagaatcataggcatgtatcattaagactgtagattcctagcatctattacccaaaattcccgaaattcttgggaatcggcatttttaacaaacctaccaggtgatcctgatgcagatgattcaggttttacttttgagaaaccactgtactacgtaagtctaagagtgactgcactctctgtccttgctatttatttttctcttctttcattcttagagatttgttccaccaatgaggcagaaaagtttgggaacagagcaatgcccatttacttaagcaaccttacatttctaaagccaggacattgccccctttctgatagtcgtggatattctctttaaaatacaaactaacattggcttttttgggtgataagaatttaagtgctgactacctgcactgtattaatgagaaaaatccaattatggttaaatgatttaatacccacacgccccaaacacctggcctccattaagaaaggtccactcactactttctgacagttcagtgacaacaactgtcaaataagggacaattctccatttagtaaaataagggcataaggcagtttaagcaatttatcactatcacagatatgggaagcagggtaggagacagctgtaacatccacgccacacacattcacattcaataatggagagagaaggaatgttgaggctctagcaactctgtgtttcccaagatgattccatccccccagaatcccctttactaatatgggtttgcaccagtttagataaaacggcagctctctgaaaggaggtgttgaatcctacagttaaagatgctctagaaatggaatatggggttattagcactatttcttctcagctgatagatttggtcattcatcatttttaggaaagagggaaagactccagcctttcacacctatgttgtaagcattgtttgtaatattctcttttcagctgtgatgactagaaattcagttcaaaagaagataatttctaaagaacacacacacacacacacacacacacacacacgtgtatatatattttctggtgacctaaagacagagacttagtacaaaagtgcctcaatgggcctgtaattgagaagtggcggaaatgtagataattacgattttctctttatctctgtaaattctcttgttctttgacacttttttttgaagtatcttcccttatctttgtgtctttttctgtacctctctcttctctctttgggtttcccccatttgttcacattgaatataactgtgagtctgtgttttagttccaataagcagcatcaactttgcccttatcaatctttagacagccttaagcttgtctctgattaagctcaggctactgtgccatcagctgctgaaaattctatgttattgtcattgtttgtgtgtctcctctaatctaatttcctaaagtaaaaagtggaggactaagtaaggctatgcaatttttgtccacccaagagggactgggatttgagcaggcaacattaactttgctcctaagagaaagtcccaacactctaatcattttttctgtttcatactgttaaaacatgtccctggctgacagacaaaatggactccctatgactaactgaagtaagttaaaacaaaaccaacaaaaccaggtggccatgcctgagtgacaaagtggtcgcatactctgtgttctcagaaagatgtcaaagcatcacaggatcttcctttctacaattgatatggtttgggtgtgtcctcatgcaaatttcatcttgaattgtagcttccataattcccacgtgttgtgggagggagctggtgtgagataattgaatcatggcatttccccatactgtttttgtggtagtgaataagtctcatgagatctgatgcttttataaagggaaatcactttcacttgattaaattctctcttagtctgcttccatgtaagacatgccttttgcctcccaccaagattgtgaggcctcccaggcacatggaactgagtccattaaacctctttttctttatacattacccagtctcacgtatgtctttatcagaagtgtgaaaacagactaacacagtaaattggcactggtagagtggggtcctgctgtaaagatatcaaaaaatgtggaggcaactttggaactgggtggcaggcagaggttggaacagtttggagggctcagaaggacaggaaaaggtgggaatgtttggaacttcctagagactttttcattggctttgaccaaaatgctgataatgatacggacaatgaaatccagggtaaagtgatctcagatggagatgaggatactggagtaaaggtaacccttgctatgttttatcaaagagactggtggcattttgtccctgacgtagagatttgtggaaccttgaatttgagggagatgatttaggttatttggtgacataagtttctaagtagcaaaacattcaagatgtgacttcagtgccattaaaagcattcagttttaaaagtgagacagagcataaaaattcagaaaatttgcagcctgataatgcagtagaaaagaaacacccattttctgaggagaaattcaagccagttgcagaaatttgcataagtaatgaggaaccaaatgttaatcaccaaggcatggggaaaatgtctccagggtgtgtcagagacatttgtggcagcccctcccatcataggccaggagccctaggagaaaaaagcggtttcatgggccaggtcctggacccccctttccgtgtgcagcctaggaactcggtgccccgtgtcccagctgctccagccatggctataaggagtgaagacatagctcaggctgcggcttcagaaggtgcaagccccaagccttggtagctttcacatggtgtggagcctatgggtccgcagaagtcaagaactgaggtttgggaacctccacctagatttcagaggatgtatggaaatgcctggatgtccagacaaaagtttgctgaaggggcagggccctcatggagaacctctgctagggcagcatggaaaggaagtgtggggttgaagtccccacaaagagttgccactggcgcactgcctagtgaagctgtgagtagagggccactgtcctccagaacccagaaagtagatttactgatagtttgcactgcatgcctggaaagcagcagacactcaaggccaaactgtgaaagcagccaggagggaggctgtaccctgcaaagcaacaggggtggagctgcccaagaccatgggaacccacttcttgcatcagcatgacctggatgtgagacatggtgtcaaagaagatcattttggagctttaagatttgactgccccactggatttcagacttgtatagggcctttagaccctttgtttttgccaatttctctcatttggaatgtatatatatatatattcatacccaatgcctgtacccccattttatctaggaagtaactaacttacttttgattttacaggctcatgggtgtaaggaacttgctttgtctcagatgagactttggactgtgagcttttgagttaatgatgaaatgagttaaaactttgagggactgttggtaaggcatgattggttttaaaatgtgaggacatgagatttgggaggtgccaggtgtagagtaatatgatttggctgaatccccacccaaatctcaccttgaactgtagctcccataatccccaagtgttgagggagggacccggtgagagataattaaatcatgggggtggcctccccagccacgtggaactgtgggtccattaaacccctttttctttataaattacccagtctcaggtatgtctttatcaacagcgtgaaaacggactaacacaacaataaagcaaaaacagatcctgttcttggtgccaagataaactacagctggaactacttccttttgccccctatgccatccctacactggccctttagcactagccctttgaaagaaacatctgacagaaacttctggtttggggcttggaaatcaaccaatcagagctcacctgaatcaaccaatcagtgtatagaacagtcatgactcatctgttttgaccaatcagaattaagcaaggatctatccttcatttggatgaagacagcttattgggaacctgggtgggaactatagctataaaaccctaaccctctctttgttctctgaaatgtgtcttagcttgaaaccacaggctgtatatccatggtttgaaaactgttcactgaaataaagtctctttcgtccaaattcctttccagagaacatttgcttacaatataaatttaccactctccctcacacaaatacaaacagattcattcacatttaatgatgcattatgattacaatgcagttcaacttatcttattccatccaacttccaaggaaactgtatttgtgtttggttgggttttgaaacttaaaagtcacagccttggtgtgaaaagactgaggttcgaagttttacacaaagaaggcctttacaccagtcttaattatacatgagtttccagtaaaatgagaatattatgaatttatggaggcatggaaatctcatgatataatgtaccctgaaaagtattattaaactacagtaaattttttagtaacctacctaggaataagtaatcactgttttagcttaaccttaaatattttattgacatctgaaatttggactttgacatatatacacacacacagaactacttcaggatggtgatttttttaaaaatcgtttgtccttaaaatgtggttttaacttcctgactcaggaaattcaaatgcttacacattacaaatgaaaattatggcttacattttctgaattatctcaaagctacggggagtcaaacatattacaaaagaaggacaatttactcaggaggacttgataaaagatgttaccacccactgaaacaccactgtaatacctcaaagaaagaagctgcttatgcatattgcttaagtgtcttcattttttttttctgagtagtaacagtagtgaataacaatgttatgctgcttcctcagtaaactggagactgctacaagggacatgtcatcagtctcctccttatcactttaggtcaaacttaaaatgctgaataaacatgcctccagtctggcattaaaataaaaaaaaagatcaaaaagacatgataattattgtctaaatagtcttatcaatcttgctaacaatgagatttaatatatcagaatacctatatttagatttttccatataagacaaattctcaaaaatgaaagttactgcagatcatgtgatgacaaattcttatcaatttcagagttcttcttttattttttcaaaacaaactaattcaagcttgtctaacccatagcccacaggctacatggggcccaggttggctctgaatgtggcccaacacaaacatgtaaatgtccttaaaacattataagatttatttgtgattttttattatcagctcatcagctgtcattcacgttagtgtaatttgtgtgtggcccaagacaattctttttcttccagtgtggctcagggaagccaaaagattagacagacacctctgaattagttcagtgcattatgaacactcttactttgtattaccatgaaggcattaaacaaaaaaaaaaatcagcagtattttacaataactgtgatgagtacactagaaattgcatagaaattaaatgcccctaattaaaggcctgacaacatatattgtccagtacatatttttacatattgtctactaccaagttccaacagataattcaagtggtacttaataaacaaaaggtgaccaaatgagaaaatgaacttatacaaaagaaagaagaatgcttcttcttctgaacaatagtgcagactgacaaagattctttgcctggccaaacttgatcaggcttctgaatcttctcctaggctcatctgtatacttcctcataaaatcactttttaacaaagaaccatactatatcactttaccaagaactcctctacctttgatgaatgatctatcttgaaaactcatcaggtttctcatcctgcaccaccccttaggtgatgtctgatcaccctgacttgtcttcagcaacaatcgtattagcgtgttttagccagaattcccctaatctctgatgtttcctcctagtaattttccatccagtgaccctgaccctgctccttggttataaagtcccacttgcccatgctttatttttagttgagtccaatatctctctccaactgcaagacctcattgcaatgatttctatacctattgcagtggtcctgaataaggtctttcttaccatgttttaatgtatcattaaataatatttttatttaacaattgtctagaggacttttagaagaagatatttactaaattatttttttctaaatacatcagccatgaaaggatagggaatgctgcaggaacaaacccttaaactttcatttttttctttacttttcatatctacatatctaatatgcatcagcaagtggtctctttttattgttgtcattggctaatgaatgtttctcctcaacatgtttttctctgatcacaacagcaggggcagagaatatgattacttgtatattggttctttgagtttacatttcattagtcaaagcaaatacttttctccaggcaagaaaagtacacctctagtatgaatcaaaagagaggaagaaccaaacatttttggtaaacagctcaagtgcttttgttaacagcagtgaatccatatgggtctgcagcaactcggtcctaacctcagaggaaagaatgtgatttaggggaagaagtaagtttaaggcagagggagagattgaggtgagttttagagtaagagtgagagcttattaaaaagttttagagcaggaatgaaagcaagcaaaatactcttggaagacggctaagtgggtgacttgaaagatccaagtgccttgttcatcccttcacttgggggttttctacattggcatggtttgggggtttgccattctcctcccttgatttttcttttggggcaggctgtccacatgcacagtgcctgctggtgcacttgggagggtcttcatgtgcagtatgtttactgaagttgttgcatgcttacttgaggcatttttgccttaccagtttaacattcccagaaaaaggtcatatactagtgaaattctgccattttgcctcttaacgtgcatgcttcagccctcttgcccaacttctaagctcttattgggaagctgctgatcaccagcttcaagtgttttctatctattgggagactatatttccctggcactggctgtgatcaattattcttttacagaaaaagtttaaaagccacctaaccatcacctgacgatcagctgacattcctgggggtggtcctctcctgccctgctcatatctgcctaaccatctagttgatatggtttggctctgtgtccccacccaaaacaaattacaatgtcaaattgtaatccccatgtattgagggagggatctggtaggtggtgactggtttatgggggcagtttcccccatgctgttctcccgatagtgagttctcacgagatctgatggtttaaaagtggcacttccatttttgctctttctgcctcctgctgcatgtaagatacaccatgcttctccttcaccttctgccatgattgtaagtttcctgaggtgtccctagccattcagaactgtgagtcagttaaacctcctttctttgtaaattacacactctcaggtagtatctttatagcagtgtgataacaaactaatacaggaaattggtactgggatagtggagtactgttaagatgataacctgaaaatatagaagcaactttggaactgggtaatggtcagaggttggaacagtttggagggctcagaagaaaacaggaagatgtgggaaagtttggaccttcctagagactttgtgaatgctttcaaccaaaatgctgatagtgatacggacaatgaagtccaggctgaggtggtctcagatggaggtgaggaacttattgggaactggagcaaaagtcactcttgctatgctttagcaaagagactggtggcattttgcccctgccctagatctgtggaacttggaacttgagaaagatgatttagggtatctggcaggagaaatttctaagcagcaaagtattcaagatgtgacctgtctttttctgaaagcatacagtcataggcatatatgaagacattatgtgaaactggaacttatgtttaaaagggaagcagagaataaaactttaaagaatctgcagcctgaccatgtggtagaaaagaaaatcccattttctgggggaaaattcaagctgggtgcagaaatttgcataagtaacgaggaaccaactattaatagccaagacaatgggaaaaatgcctccagggcattttagggatcttcatggcagccgctcaaatcacaggcctggaggcctaggagggaaaaatggttttctgagctgggaccagggccccactgctctgtgcagccttaggacatggcatcctatgtccctgccactctagctccagccatggctaaaatgtacagttcaggccattgcttcagaggtgcaagccccatgccttggtggcttacatgtggtgttgggcctgcaggtacatagaagacaagagttgagctttgggaacctccaccttggtttcagaggatgtgtgaaaatgccagcatgtccaggcagatatctgctgcaggggtggagccctcatggaaaacatctactagcataatgcagagggaaaaagtggaattggagtccccacttgggactgcctagtggagctgtgaaaagagtcccactgtctcctccagatcctagaatgatagatccacagacagcttgcatcatgtgcttggaaaaaccacaagcactcaatgccagcctgagaaggcagctgcaggggcagtaccctgcagagccacagggacatagctgcccaaggccttggaagcttaccctttgcattaatgtgccctggatgtgagacatggagtcaaatgagattatttcgaagctttaagatttaataactgccctgctgtgttgtggacttgcatggggcctgtggtgcctttatttgggccaatttctcacatacagaatgggtgtatatacctaatgtctgtaccctcattgtatcttggaagtaacaacttgtttttgattttataggcttatgggttaaagggaattgacttgtctcagatgaaactttgaacttggacttttgagttaatgctgaaatgatttaagactttagggaactattgagaaggcatgattggttctgaaatgtcaaaaggacaagagatttggaagaggccatggttggaattatatggtttgtctctgtgtcccgactaaaatctcatgttgaattgtaatctccatgaatctagggagtgacctggtgggaggtgactggatcatggggcagttttccccctgctgtttttgtgagagtgagggcattctcatgaggtctgatggtttaatagtgataattcccccttcactctctctctcctgctgccatgtaagatgttccttcctccccctttcccttttgctgtgattgtaagtttcctgaggccttcccagccatttggaactgtgagtcatttaaaattattttattataaattacccagtcttagttattctttatagaagtgtgaaaatgcacactactgtaacactttcactttaaattggatcaatcagttcagcaactatttattcccaaacttgttgcttctttgttttagaacaccatttgaattgcaataaaaagagttgcttaagttctttgtagatttgcggggggaggtgggaggggagagggacagcattaggagatatacctaatgtaaatgacgagttaacaggtgcagcacaccaacatggcacatgtatacatatgtaacaaacccgcacgttgtgcacatgtaccctagaacttaaagtaaaataataaaaaataaaaaataaaaataaaaataagttgaaacataaaaaaaaagatttgcaacaaaacagaaaggctcaatttaattattccaattttattcatatattaaataaaatagttatggtgaagaatttacaatattttgctttattgaaatgttattattttgactagtaaaagtgccacactatggtgctattaatgtaagcagaattactagagatttagtagtagcagaacataaaatttatcatgtattttctcacaggtcttacaagagaagaaactggtactgaggtttacactaattttatatgaagtctaaaagtggattctctccctaagattgtaccttggttaatccttttttccttcaatacatcctaagttaagtgtcatgatgtcttactattttttccacagaattaagagcattttagcttgctaaaacatatattatttatttttcttttttcatttgtaattttgaaaatgcatgtggttgattggtttatccactctgtagggagtaagagttacatattatattgtacagcaaacctacacttccctggaatggggaggcattgagacagaattattgcacagttaaaaaagaatttaagccttattaactgtctacattttaagcagaaagatagtttaaagtaatatatttttgctctcaaactatatctaaacattgaatatttttatgcatgcaataaatatctccctaaaaaacatggactagtcatttgatacttgctgggaggttttatttttacaccttggggagtaaagattagaaagtaaccttcataaaatttgagctagaaacatggcgcacacgtacaattaattctttaaaaaaatacctaaagagcaaacaaaataaatggtttcaaaatcgaatgttcagtcagctgtttctacatttaagaaaaagcatttctgctgcccttttctttgctgtttctttgctacttcccacttcatttcttatgtaacccttcatactgtccttctctgtcacattctcatcatatccccaactcttggttttattgtctctgcctaaaaaaaagtcctcttttagagaaacaaagcaaaaaaaaaaaaaaaaaaaaaacaagactctaaaatctgaccttcaccctgctaataaaatgtatatatatatattatatatatatacttattttccaaatttattaaaattttaacacagccagtacaagttttttttgtgagaacacaatagaggaagagtatactgaaactggattttacagttcagaagtagttttctaatatgacccaaatcacttcacttacgagttttctttgctatgcaacagagataatactacttttaactgatttgtgaggataaaatgagaaaatgcatccacaatttacttaacataatgcaataaatttgtgatgtagatcttactgtgagttctcagactctactatcccaatagagttttttgtttgtttgtttttgcttgtctgtctaaagtttatctacaacatacaatggtaaaaataagggcaaaatgttaacttcaccattgtttatatttctaatatttattaaacataaaagagatgcattcaatttgaaagcttatttaagtagtgcatttataattgctttggggggcccgtgggattttgaggagctgcctcaaagaaagtggggagatgtgaggcaaggcttccagctctagcttcagttaaaaaaaatcttactttgtctgtttttttgaataatatgtcattagaggaaatgattcatggccttaaaaaacaacatagaaatcttcttgtctatttgggaggccgaggcaggcggatcacgaggtcaggagattgagaccatcctggctaacacagtgaaaccccatctctactaaatatacaaaaaaattgagcttccagtgagccaagatcacgccactgcactccagcctgggcaacagagcgagactccgtctcaaaaaaaaaaaaaaaaaaaaaaaaaaaaaaaaagaaatcatcttgtctaatggaaaaaaaggaagaaaaacaacaaaataaaacagactatagctagtggctttgtcttgtcttcttctctatctttggtttaactggtggacggctagaagtttaaaggcttatcaactccagcaatacttggtgtgtgttcttgaggtatagcaacaatattggtattaatttatgagttgcataaaattcatgtttgacacttgttatctcatctccagtgatttatttagaatgctttggagaccacaaacataacagaaatttagtaaatgaggcatattatacctatgaatatattttaaaccttatctaaaaataccatcaaaaattagcttctagcaataaagcataaatattacaaataattcaattttgagacatttttaaataatagtatcattactaatctggttctggaagttactgaataatacaataactatcagctgaaaaaatcattaattttattccttttaagaaaattacattgcaaataggtatttacataccggatcatctggattatactgaataacatactctatctgtccatttggtccatcatctatatctgtagctccattgtctcctgaaaatcctgtgaatattgtggtaccaactggagtgagctgaaaggaaaaaagattttaaatatcaattttcattttatcaactgcacaccagaaatgttacagcataaaaatcagctctttattacctaaaggaagataccagttggcagcccacaaccacaaactgaagtgtttcaaaagaacagttttgagccttacacaggagttcttaaaatgtctgaaatgtccaactttgtgattcttgctatgggcgaagaagcagaagacgctgattccgtgttaaacacatttggaccaatttatagccattagtatgttagctcctgtggagaaactgcatctgttgtttctcctcaaaacccttgatgcaatgttacccacaggctagaatttaaactgtaagaaaaagttagtttaaaataaacgatttacgagtgagcaatgaaatccaggctgatgattatatgcaagtggcaagtttgagaaagagaaattggagacaatgaatagtctgtatattagaggaaaatactgggagtttcttgagtccttctgatattggttgagtagaacatgatcaggtcacagcagctggagagatagcaacatcttttcattttggattaaaacatcagaacttaatatgtgtggcatacaaaaccatgatttgatgtgtgacctaaattgctagtcttaattcttacttatgcccacaagagaatcaccgttatttttttttacctgtaggtttttgcgcaatgtgctcttataaccagagtaatttttttaaattttcccctcccagtttttaggttttagctgaaatactactcattagttaaatttcaacttaattagatatcagcttctcccataccacccctcaaatagcattacacacgccacatcagaagatgattccccttttcttgtgcttgcattttgcactttgttcctataatcattgcattgttagaggaactaaatgcacttcatcaataaacataagctctgtgcctctacagactggacgcttttaatgtttgctcagggatttgttctcttaatttttgactaggattccttgatggtaaaaatagcttaagaggcaacaaaaaagttgccttattcagttttactttcagaaactgaaaattcacattttacaaggatccctcaggtaatgtaaatgagtgaagcaagcatgatgagacggtggaaaatagatagaacatgccctctctgatgctactcagagagggtagctgctactagtagctgctactcaatcccagcaaattcttgccatcttggaatatggagcccatgctaccaagtcttctaatattttaattgtatataaaatatcttgatgctaagattgacaacagatttttattatttatttatttatttttgagatggagtctcactctgtcacccaggctggagtgcagtggcacggtctcggcttactgcaagctctgcctcccgggttcacgccattctcctgcctcagcctcccaagtagctgggaccacaggcgcccaccaccacgcccggctaattttttgtatttttagtagagatggggtttcaccgcgttagcaaggatggtctcgatctcctgacctcatgatctgcccacctcagcctcccaaagtgctgggattacaggcttgagccaccgcgcccggctgacaacagatttttaaacattaaaatataaataggtaaaataaaatatgcccattgcctcaacaactacactagtttgcaatctctgatttaggaaaagaatataattatgacttaaaaataaaccataagtacaaggaagttcaggatttataaggcccagtttcctagcaggcagcattgaaggcaaactttggagagctgagaatgaagtgagacgagatcgtttaagtagtacctatgaggacatcgagggaccactggggatagatttagtagaaatgttagtcagctaaattgcttccaagctgacgttcaatatttttcttttttaatggaattcctgttgcaaaagacatccttatcttttataaatattcacccattcttatgtagctgtactttgatatttttattaccaacttatttttaaatcaacatatagaattttgtatatttgttgtgtacaacatgttgttttaaaatatgtataccttgtgtgatggctaaaccaagctaattaacatatctattatatacttttttgtggtgagagcacttaaaaaatctattttcaaaaatagatagttattaactatagttaccatgttgtacaatagatttattgaatttattagttcaagaaatttaaattttgtatcctttgaccaacatctctcaatccatatcccagcccctagtaaccactcttatactgtctgctgcaattacttcaactactttagattccacatacaagtgggatcatgtagtatctgaatatctgtgcttggcttgtttcacttaacataatgtcttccaggtttatccataattttcaaactgtgaaattttatgattggatgacattgatttgtttccatatatctaataaacttaaaaattttgttgccaaaaaatactatgtcatggaggtagatataaaagcaaaacaaaaaatcaaaataaaacaaacaaattttaaaaaattaaacagtatcgtctgtggaaattttgaggaaataaagggggtgcccatgcctttcaatctgcttactggggtaatgtatactattggaccagatttattttgaagagcaggatcccaaagccctacaacttagggagataaaattggtcttgcggggaagatataggacatccagggagaacttcacgtttgccactcttaatcaagattaaatttctggaataaatatttatatgacagaaatttgttggaatagatggtttgaaagattttagtccttacaatgtaatatttgtaaagttgaaggcatatttctaaattcaatatgcaaactattgaaaagatcaatgtttttctctagctctacaatgtttttttgaaatgatgaaaaggccacataaaagtagcatgatgtcttaatatattaccatcaagtaatatttttcttcatcactgacatggctttttccatgcagaaatcacatttgtaagtataatgtttaatatgtagtcctttaaaataaactctacattgttataatgtttaatatgtagtcctttaaaataaactctacattgtatttctttgattgactttcaaaaaatatacttgctgatgaagcctaccaaagattgataatagaccacaggaaaaaaattgaatatgcatttgcttatggtttcaattttaagcttaatccaaagagtaattcaatttcaaatgttctcatttcagaatatgagctcattttgtgtgccacaggtaaatttccctaatcatatttgtgtggccatatatacttttattatttctgaaaaattgcaagtagaaatatgattctataataaatttcattaatttatatctttgaatagaaaataaaagagaaacaattgtattagccgtaggaatagagaaaaccttttttctataatgatattatataaaggttatgaatcatccctaaatataattttaaggtcttttttagacaaaattttagattccttgaaaattaaatgaaaagcattagtgtaatagcaatagatttcagcatgttctttcattcatggctgtctttcttgacaatttcagtaaaaatttctccctaatttcacaaatatggtatttactggctgacaggggaggatgggcaggctcaggaattgtcccaaggtgaggtttgctctcctccatagttccacatttaaggcaaatgtcttagcacagatcactcctgtgtatttctactactagattgtgcaagcatgtacaaatagccattcatatgtaaaatgcaacacaaaatggatcagtcatacatttttctcatgatctgctcaaatttcatgatttgttcaaatggtagacctgttcacatatgagatagggttgaggctaatatgagagaaatagccgagaaaaaagaagataagttatatgggcaaacatgggaggtctgaaaagtctaaaaaggctctaatgaagaggcctatgccagatgcaaaaaagcagaagaaagtagaagcagaaaaaatgttttttaaaaaatagtagatcctggccagatgccatggctcacacctgtaatcccagcactttgggaggctgaggcaggaggattgctgcttcaagtctgagagtttaagagtttgagagtagagatagatagatagataataggcctggacacggtggctaacgcctgtaatcccaacaatttgggaggctgaactagatggattacttgaggtcaggagttggagtccagcctggccagcatggtgaaatcctgtctctactaaaaatacaaaaattaaccaggcatggtggtgcacacctgtagtcccagctactcaggaggctgaggcaggagaatcccttgaacccaggagactgaggttgcagtgagctgagatcgtggcactgcactccagcctggggcgagaacaagactctgtctcaatttaaaaaaaaaaaaagatagatagatagtaggtggttatatgtatattatattcagatcttttttgtgctattataaaactgtgaacaaagagacctaccttatgtttcatagataactctttaatgctatatctcaaaatcacaactaccttattatcattacaaaaaccaaacaaaagacatggcagaaagcccacacctaaatgggcaggtagcattgaaatgtatgcaaaaacagagtgttagtagtgaactgaaataaatttaaaaggtccctcttgacagcctatttgcatccaaaagctctttaaagacagaccataatttttttctttttaaaaaaatatttcatagcatcaattgtagaaactggttcatcagtagaaactcaattaattattcttatttatatatattatttatgcagatgagactgaaacttttcacaatttcttcatattttaatatactaaatcctctacaaggcctctatactggaatactgtatccacatcctcatcctctacctgcctgttcctggttcctcggacaacctcacttttagaggtgatttccacccattcattatgctgttcaattgcaacaggatggccagagcttctggcagctcactgtcaaaaaaccctgcccacctttttttgcttccatgaagaaaaatatgtagatttcactgtgaagtctagttcttcccatgctcttgccagttttcctacaagaaaattttctacagactgtccatgaataaactataaccataataggacccaatacagcaagcacatgcaagtagaataaccttatattcacgaaaccgatggtatgctgttcacttggaataaaatattgagaaggatatgtggtagaaagtcctccacaaatcataatattgtgttgtacatatatatttggtgattagaaaattccactggcatcaatatcattgtgttggtagataacaatgattttctgtttcatattttctggagtctcatgtgtcatatcaacacagaaacaaaaagtttagtaaaaaataaaatactaaaaaatgatttctgaatacctaaaatagtttacacatgtattccacaccaatgccttctgatagattctaatggctttaatgattaaacagaaaccatatgagagtcctaagaagagaaaacatatatttttatgtaatagacacaacttaaataatacctcttcaactggaagacaattggtacaaaaggatattattcaatttggaaacttgcccccaaaaagagccaccctagaggaaaaatttaaaatacgattgatgagattttactttttcccatgcttcctcaagaatccaagttttttgttttctcctacccaggaaaaatggagaatatctgaaggatactgaattttagataagctgaaacagaattaatcactacagttacttatcatataatgatgatttgatgaaagaaatgctaccggggtggcaggtgctctatttctactaatagacattaacaaaaaagaagcattacctttagtgatgcaagattacatatcagcctatgttaaaacactacacatttattttccaattgttaatatcattgatctgatttatagtattaggcagccacttcatgtcaattaatctcctagaaaacccaatcaagataaggcaacattctgtacaaattatcattactagtgaaactgaaggaatcttccacgtttaatcaacaatgagaactatgattcatcctttaactttctccccagataaaataatgttatagattcattcttgcaattaatccctgccttggaaatatgctttagaaatggtaaatttagaaattttaaaccaaagattctccacacatgaaatccagagttgattttgtaaacaggcagtcatcagtggaatattattgaaaaattcaacattttctgacaattatgaaattacaatgtctctgaatctacgattatttattgagaaaatatcgtttgccaaatcattgtttctgtgaccattatattggtcttactttaactagtaaatataacatttgttttattcaaccatttttccaaatcaaacatccgtttgaagtccatcttaaaactttccagaactgataaaaaaaatacatattcttgaattcaaatacagtgcaagttatcttgtaatgatttattaacattaaagaaaacataagaaaagaggtatagccctttttgtctagttaacattaacttatgaaggtacaatttatattaaacaaaatgcagagatcttaaatattcagtatgttgagttttgacaatttcatgaacccatgtaatgaacacctacacaaaaaatataatatttttatcacactgtaaaatttcctaatatccctgtacagactatcttgtcagatgcagctgcttttgacttcaatcaaaattgcttagttttgcctgttcttggacttcaatagagtgtgtaccctttcctatctggcttcttttgctcaacttaatgttttttttgtttgtccttggtccatctattttattctgtttcattaatgtttttcagattccctttaacataatatggttttcatacctgtgttaaaaatcttgatttcattaaaaatcttgattccattttttatcacaaagactagatgattaatattaagggttactttctctgaataaataatagacaaattcatgtagataagtgtatttaaaataaaaaaagaattattactgttacagagaatgataaataactctatctttactaaaaactgaggagcaattaagcttaagttgaatatacatatgagcttatttatttatttatctatttatttatttttgagatgacgagtttcgctcttgttggccaggctggagtgcaatggcacaatctcggctcaccgcaacctccacctcctgggttcaagcaattctcctgcctcagcctcccaagtagctgggattacaggcatgcgccaccacgcctggctaattttgtgtttttagtagagacgtggtttctccatgttggacaggctagtctcaaactcccgacctcaggtgatccgcctgcctcggccttccaaagtgctgggattacaagcaaaagccactgtgcccggcccatatgagcttagaagttgttgaatatttgaatacttgaatgttgtaaaacagctaaaaaattgattcccacgtacatgcttaaagtaaaaagaaatgtattaatatgtgcttctttcacttcctttaatctccttatctctttctcttttttaactgtttcctgattctcagagagaatgtgcccatcctatggaagagaaaaatggggacaagtaagaggaactagagattagtcttacttctttctttaactttagattaagtgccagtactgcatattcaaagaaattccataaatggggatgctcctgaaggcccagtgatttttattccttgaaaagttgaagatatcgagttttgaactccatgatccatgtttctaaaccataatttatttcatattaaaaaatcacttaattatacctagaaattgtaaacaaaacacacaaaatatgtaaaaaaggatattcaactctataaggaatgtcagtgttatgcttctcatgaatactgtctgtgcttttagatttaccagaataattctgataaaaacagatgttcaaaatatatgtattaaatggaaggagatgatataaccacaatgaaatgtaaaagaatagcataaaactatgagaaatggatttggaaagcaaaaactcaaattagatagattcagaggtaatgttaatttcaccacaaagctgaagtctcaataatgttccactaattactgcctgtttataagtgtatctctacactttcatgtgtggagaaactcttggttttcaaatctgtcactatttccaaagcgtatttccaaaacaggaggattgcaaaaaaaaaaaaaaaaaaaaaaaaaatggctaaaacctgcactaagtattttaaaagtatcacctcctttaatcctcaatacaagtttatatcattatttattttgttatcatacttattttatggttacaaaattataggcttagaaagcttctgcctgatgttattattctaatacttggtgaataatctgaaatgatataatttagattatgtatctcattaaagataatttattttgggcccctaagaaaaatgttttgggttattttacagaaggagaaataaattcaacttaattataaaatatctcaaataatatatggcacagtgtcttgtttaaaagtattcattcttaaacactgtgcaatatgttatttgagaaatgttagaattcactattaatgaacttctgaaaaaatgagaaataaacaggaaaacaaaatgtggcacataacagaacccaagattcacagacaatctgaaaccatataatttagattatgtattaaagataaattattttgggccctaagaaaaatattttgggttattttacaaaaggagacataaaatcaaattagccagtacctgcattttaggaaactcttcttcaaataattattactgtcagaaaaaaattggttctcagcaagcaaattatttaataaatttccaaattcaccatgatttcagtgtgcaaacctttacattagtaatcaaatctctattgctagaacatgcctaaaccattgaaaagcattcaataagcgctcaaggagcaaagagaagaagaaatatagccaaccacagtaatttacactttcctcaattatatttcaaaaaataatatttcaacaatcactaataaaaatggtgggtaaaagttcaatgagaaacaggatagttacagtcttaacctagttccccacaatatagctttaatacttattaagtattaagtacaaaattactggtaaatacagaagggaaagctggaagacactgttttgtcaaagtgataaaagccatcactaccaataatgaaacagatacattgtgtgtcttttgtgttacatgctatgataaaaacagtatcatttttgaaacattcatgcacaaagtctacgaatcatgagaaaatatcaggtgaattaaaatttagagacattttatacactcctctggtcctgaaaaatattaaggtcatgaaagtcaaggaagtattgtggaaatgctaaaattgagactaaaaaaattgaaaactaaacttggttttaggaaatacacaataaagtagtaagggctgaagaagtttcatattttcaacttaattttcattagtataaaatagttatgtatttatatatgacatatagtatacattatatataattacatggtatatatacacttaatgtatgacatacttatatatacatataatatatgctgtatatttatcatacacacaaaaatctacctctatgtgactatttatcaattagtaagaggaaagaaatattgtctgaccagtgagtctcaatactgtcaaggtcatcaaaaacaaaaaaaaagcaaaaactatcacagtttagaggagactgaagaaacatggtaaataaaagtaattgttattctgtatggggacctggaatcaaacaggacattaggtaaaaagcttatccaccatgatcaagtgggattcatccccgggatgcaaggctggttcaatatacacaaatcaataaatgtaatcccccatataaacagaaccaaagacaaacaccacatgattatctcaatagatgcagaaaaggcctttgacaaaattcaacaacccttcatgctaaaaaatctcaataaattaggtattgatgggacttatctcaaaataataagagctatcaatgacaaacccacagccaatatcatactgaatgggcaaaaactggaagcattccctttgaaaatgggcacaagacagggatgccctctctcaccactcctattcaacatagtgttggaagttctggccagggcagttaggcaggagaaggaaataaagggtattcaattaggaaaagaggaagtcaaattgtccctgtttgcagatgatgacatgactgtatatctgaaaaccccactgtctcagcccaaaatctccttaagctgataagcaaattcagcaaagtctcaggatacaaaatcaatgtacaaaaatcacaagcattcttatacaccaataacagacaaatagagagccaaatcatgagtgatctcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctatgaatgactttcttcacagaattggaaaaaactactttaaagttcatatgacaccaaaaaagagcctgcatcgccaagtcaatcctaagccaaaaccacaaagctggaggcatcacgctacctgacttcaaagtatactacaaggctacagtaaccaaaacagcatggtactggtaccaaaacagagatatagatcaatggaacagaacagagccctcagaaataacaccacatatctacaactatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaacattagaccttaaacgataaaaaaccctagaagaaaacctaggcattaccattcaggacataggcgtgggcaaggacttcatgtctaaaacaccaaaagcaatggcaacaaaagctaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggctatcagagaaatgcaactcaaaaccacaatgagataccatctcacacaagttagaatggcaatcattaaaagtcagggaacaacaaatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactagaaatcatgctgctgtaaagacacatgcacatgtatgtttactgcagcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcattcataggtgggaattgaacaatgagaacacatggacacaggaaggggaacatcacactctggggactgttgtggggtggggggagggggagggatagcattaggagatatacctaatgctaaatgacgagttaatgggtgcagcacaccagcatggcacatgtgtacatatgtaactaacctgcacattgtgcacatgtaccctaaaacttaaagtataataaaaacaaaaaacaaaacacagggaattaaaaatgaataaatttggttctctatatatgtacatagtgctctaactttttaaagcttaaataaacctttaaaaaactaaaaaaaaacaaaaactaaaaccatctgaataagctatgaatttgaattaataatgtaccaatgttggtttattagttgttacaaaaaatgtactatattaatttaagaagttaacaatcagggaactgtatatgggacatatgagaactgtacacttctattaaaatatcacttaggtctaaattgttctcatattatttaaataaataatgtaaaatatagttgtaaatagaccatttccattaccattttcattataacaaagctcaagacttgaatatatcatttaatataagaaaaataatgtttaaatgtaatatagctttacttctattacatttaatttttataaatataatgcacattgaaccaattatttgtcaacaaatttaataagatatacttatagaatgaaacagagtaaacagagaggaagagatagattttcatgtttttctgtgctttcatttggctgaagtttggttttttgtgtgtctgctaattgataaaatcattaaaaatgtttttagtcattcctttaaaatttcaaagaaaagctaaaatatttaaaaactcattgtttaaaattaagagctaattgatgcagtaggtattgatgaaagatatgattatgtcatgttaggagaaacaagcataataatatttaaaataaattaatatgcaattactaattaaatcagcatgtaataccaggtaagaagaaatactgaaactggtctaatcatcccacagaactgatgtttatgttttcgtctgaataaacctagaaactgatgctcccagttctgaaacttgcaaaagttacatttgccctgtctgagttcctttcccaggaaaccaaccattagacctcccaggtagtatcaaggaactggagtttgccagatcgccacatcaggaaaatgagatgccagaccgcttacctgtcttgattgtctaaccaaccacctgcttcctattgaccttcatttcccctccctaattcccattttcccacatatgattacttttcttccctgctatataaaccggcaattttagtcagccaaagaaatgaatttgaggctaatctcccatctttttggctgaagcacctgattaaatccttcttttctggcaatgtttgttgcctcagtgattggctttctgtgtggtgagcggcaggacctagaccaaagccctggcattttggtaaaaattacctctatggtgagctaactattatgcatgtagttgggcagggtgttcatcttcatgggtcccatttcattaccttttagagttttttcataaatttgtgggattctatagaaaagttattaaaggttatatattcagtcaattataactttttataaccatataatcacatctgctttttcagccattgaattttgatcctacatcatcatcatcatcctatcattctattcttcatcctatagctattattttgtaagtaaggtcttttacagtgtcccctcatgatcaattaaagggcattttctggttgctactcttacaaagtttgaatagaataaaaatcagaacttgtgttgatttgaattgacaaatttatcatagggaaagtgcccatctgtgaatagaatgaagtttaaaagtatgtttattagtcttgctgttatatgggatttagcattcttcattttgtttggttataccactatgttaaccatttatttttcttatttcaaaaatataactagaaatataattagaattgacatgacatacagttattccataaaagaaggtggtaaaaacaaaaatacagttgtcccttgccatagccagattattagttctaggattcatgtatataccaaaatctgcacatactcaggtccctaattgaccctgtaaaacccacagaggtttcacatccatgaatattgtatttccatctatgcttagttgaaaaactgcatgtacaagtggaccctcacagttaaaattcgtgttgtccaagggtcaactgtaaagtttaataaaatatttcctcaaaaagaaatgcttcatggtgaaaataggtgtattttacttttagaataatattttaggaatcatgattggatgaaagcagaaactgctggatataattagaaagctcattgtcatcatcgttcctaccattcaatgagtgttatctattcattgcatgcacccagcaccataggtctcatgttacattctctgtatcctttaacctttaataactaccctaaaagtattatagttttttttaattgagaaaactaagtccattagaaattaattaattttccattattatacaggtaggaagtggtcatcctaaaactgaaacctatgctgtgtgactcaatagattattcccttttctcataacactgaaccttgaacatgattattttactaaactgaatcaagtgcaacttttctgaaattagtattaatatttattcatattaatggtcttacactctacactttcagattttaagactcgggaaataaatatgaattttcaaaatcgcatggaattttctctatgtactcaagccctatcagtctcttgcctaatgtatgtatacaatatggtgagcaagtgctcagttttggagtgagaatgttttggttactgacttagattggctacttatcagcagtgagatcttgagcaaattcattaatgcttccctatttctacactttctcatctgtaaaatgaaaacaatgaacacacaaagtttgagtctgtgggcagctatctataagtactaagtaagttatttcatggaaaacacttagaatttgcttggcacacaatgcaattaataaatggtaactcaatggtaattattataattcacttattattgtaaaatacctttatttcattcaaagtcaggaggtatgatatcagaaatgtggtaaacatatctatgcagtattcttattatgaacaaatttggataagaacaaatttaaaattggtctagtatgaaattagttcctaatgagtatgcctaatgacaaaaggagtaagaaaaataaacattaaaattattataaatctaaagtttgaagacatttaacctggtaagcaggacataattttctatatacttgttatgtcaatatttaccaaaaaacttgattctttcagaaactcaaggttatttaaactgctaatactcaccttcctaaattgtgaatggcattttaaatgtaaatttatgaagcatcctttaaaatttcatgttattaatactgaaagaaacagaacttgattaaacacaaattcattaagctgactgtgaagcacttgggaccctttgcgttgatccttatagagccgtgcgtctagaaaaacctttcaacgaaaagaaaaggtacatttggtcaaaggggaatcatattaatgttgcttaatcaatgagtttagtatttccgggacatgaaaagtagggtaaaaaaatctcaagtggcatgacagtcatataatgaataaatacataatttctctctaatgttttataaatagaccgtaattcatatagttcatatttatcaagttttaaaaagtgttttttgttgttcttgtcattattcttgttttaatctatgtaatttattataataatctggaaaggttatactcgtttctttaaaaaatttactctatatgagcttcttcataaatttaactcaaagcaaactcttgctttctatctcaggaacatcagcgtagaaatatatatgttataggatatttttctgtatgataactgtgccattcctaatttaatgataaacctacttatagtacttctgtaatgtgccaggcactgttctactcaatgaaaaacaaagtgccagctttaatgcagattcaattttaaaggggtagatatcataacaaaaagcaaatacatatgcagtattgttgcagataagtggtataaagataaccagcttcagatagtctgttacaagagtcataaaatatgcaggtcatttatcatacatggaaaagttgtggggcttttttctttctattttaaaatttattatgtgtcttcattgaaccttgtgaggcaaaaattctaatactaccattttcgttttcaggtgagaaatctgaagtacagaacaaattaaatgaaatgtttttaagaaagacaaatgaaactaacaaatggtaatccagcaccagcatcactgtatatttgtattgtcagcagatttagctactatggaaaatctttgaagaatctttctcaacatgatttttgatatacacatgctctaatttattgtgggtatattcaacagagtagaattgctgagtcatagggtgtctgcctgttcagtttttgttgacactacaaaataactaatgtaattgtgccaatttacttatctaccaacaatgtatgaaagttgtgattatccatatctctaccaaaacatgagagtatattttctttcaattcaaagtgtaattgaacttaaaataaataaatataattaaaactccattttggtaggtattataatccatggatggattacttttaaaaatttcattttttatttgttgctgatgtataaaatttatttcttttaaaaaatattggacggtcacagtggctcatgcctgtaatctcagcactttgggaggctgaggcaggcggatcacctgaggtcaggagttcgagaccagcctgaccaacatggagaaaacccatctctactaaaaatacaaaattagctgggtgtggtggcgcatgcctgtaattccagctactcgggaggctgaggcaggagaatcgcttgaaccctggaggcagaggttgtgctgagccaagatcgtgccattgcactccagcctgggcaaaaaagagcaaaactctgaaaaaaaaaaaaaaaattgaccttgtctgcagtaaacttgctgaactcactttttaactgtaattttttttttctgtaaatactgttgggtagttctatatataataatgccatttgtaagtatttaatttaatgccattttccaactataaggagcatttctagtttgtatttattgattttaagctcaattgtttgatgattagaaaacacattctgtataattttagccatgtgggggacatgttgatacatccgtgaaaacccagcatttggtaaattattttatatgttccatccatgtgcctgaaaagaataaacttcatagttgttggatacatcattttaaaatacatcaggtcaatttcgctgatttcaatgttcaaatcttatgtttccttgcttttttttctttacttattttgacagttactgagataacttttgcattagttttctattgctgtcataaaaattatcataaattttgtggcttaaattaatataatttactctcacacagtttggtcagtcagaagtcagagatagctctcaccaagctaaaatcaaaatgtctgtagcactgcatttctgtagactctgaaaatgaattcacttccaagctcattcagattattggctgtatttatttatttttatgttggtagctgtcgactggggttccttcaagagtattcttgcattttcaggctatattatagctccactggtgttcaaaaccagcaatagtggctaagtccttctaagtcttagattgtctttgatctccccttatgcctcatcttatccagttcctcttcccttgcctctctctgactctagccagagaaaattctttccttttaagggctcacactgagattgggcctaccagagtaatccaggataatctccctattaacttccataaccttaatcgcatctgcaaagctatttttgccaggtaagtgtacagatatctttgggaggctttaattcaaattatatgacctcccaaacatcaattttctaatttctaaaacagggatattccttccttgtaaagctactgtgaggactaaataagataatgtgcataaaaagagcttaccacagtgctcataatatagatatagctccataaacaatacattttaatttattttaatatactataggtaacccatgctttagaggtttttatagttccttcctgtctgcctcaggatggtaaaaataaataaatattgactgaaaaattttctctcaatgaaaagatcattaaaaaccagacatatataagctctatattaacttgagataaattcttcacatgaccaagaaaacattatgtctgccttgacttgctcttgtttacttacatcaaaataaattttggggggtgagatgaacctcaaaaacctgccatcactgtcgagaaagatttgtctccaaaacttgcataagaatgatcagcaactgtgtaattttttcttgaaaccaggcaaactatttacttaatgatacaattgtttaaagctaattgagtcttcacttaaagagagaaaactacttcaatgtcttatgtcttgctcatgagaaagacatttgaaaccttgttataacccgtgttcaacatgtagatagaggaattaataatgttttggtgaattcttgacaaactaatagaagaacatgtttacgaagagcgtaagagggtagcatttaatgcatttataaaagtgctgattgtgattatgatataataccataaatgtaaatcatatttatttgtaaaataaggtacatgaaagtagttataatttagaatactagaatgtttattgataagtagtgaggggatgattgacctaaggacttgagttttattcccaacttcgtggtcaattttgtaaccatcaatttatactactgctccagttctcagttttctcatggtgaataaaaagagtgactaatcaggactttaattttggaagcttcttttataaatctgtgataatgactttattatacctgtcttttgtattttaatgaagtgtgaaatattttgacattaacaatctattaaactgtgaacgatttttttggaaaaacatttagatctttcttaattgcataaacttcatgtcttatactaaaaggacaaatagtatgaaaaataccttgcaatcttgcacagaataaaactcatttcatttaattttattacaaacacagcattgtagatgggcaagatagggatatctatttatacacatacacatatatagtatgtatgtatctaattttaatgtatcttcctaatacataattcataatagataaaattcatgtcaactaaaccaatagataattcataatttataattcattggactaaactaagtactagtactatggaagaactattcaaatgaaaaatgagaataatagctaaatttctattttttttttgatgctatttcaagctttaaatgcactgttttttttttcaagaaagtaaatataaagagtatgggcaaaatcaaaggtgaaaaatatgaccatcaagtacacacatttgatattatcaaaccatagaagatatgaccatagtgtcaatgggataggatgacctcagttatctaaaaggaaatgcattgtgagaaacttaccagttcaacaatgtattgacagctttgcacagtaatatagcttctcaaaataatgtttaagatcaaatctttacctttcctataaattttatcactctgatgtttaggagtttagggtttgaagaaattgaagatcaatacatgtaaatattgattatttcataaaaataaatcaagtaaaagagatgaacaaaattttgagacttgcatggtagggaggatcttattctaggcaaaatgaacagtgtgagcaaaggctaagaaagggagatatttatgagatgtgagagagttaatctgaacaggataaggcattatcagggagaatttgagaatgttcagaatacattgacaaatggtcagattatggaaaagcttgaaggtctgccagaagaagtgaccttttgacacccgacaataatgagaaattgcaaaacttttgaaaagtagagttgcatgattaaaatgatatttgagaagttactgtttaacaagacactgaaaagattagagagggaagtggaaacagtcaaatcacataggatgctttgaacttcaaattgaacattataaatttctgaaagaaggatgaactatgaagagggatccaggggcagttagtgacatggatgaggctggaaaccgtcattctcagcaaactaacaagaacagaaaaccaaacaccacatgtcctcactcataagtgggagttgaacaatgagaacacctggacacagggaggaaaacatcacacaccggggcctgttgggggagtgagggggtaggagagggatagcattaggagaaatacctaatgtagatgatgggttgatgggtgcagcaaaccaccatggcacgtgtatacctatgtaacaaacctgcacattctgcacatgtatcccagaactaacatatatatatatgtgtatatatgtgtgtatatatatacatatatatatatagattctgtaagtagatttgttgcctaagataattcacctatcactttataccaaaaataaagttagcactcaaccgaacaaagcaaatgtaactcaaagggtgtatttcaaaataagatcatttatatataattaaaactagttacttggaaattaattagtatctgtcattacagtagaaactcattaaacaaaagtgactcaaagaggtgaagcatttatcgaccagtaattcgtcttgttaaatttaaataggagtttgtattttgtttttaagttatataatttagaaagtctcagattacaaggaacataatttcttcaaactttcatgaacacaagaatgttgaaataactaaaaaatatttttagtaacttcaaaaagaatctagaggttaaaggcccaaatgatctgtttaattcacaaattacagttattctcctgtaaagcaggcatgcaaatttttaagattaaaaaaaaatcttgaaatgaaaagatggtctggtaaaatatgtactatcacattaatgtcattcattttttcatgtgtctaacatacacataataggtcacattagaggtactctagaaatattttgtagcttaattaactaaaaataattaatacagtaaccacggtttaaaaaaaaataaaagtggttcttcacttatgcactttagccaaaagagaaaataaaacaaagcaaaacaacaaacaagcatgtccttaaaaagttacaatactactttttaaatataatttttctaatttgatcagcatttttctataagaattcggttgtgatttgtagttaatttttggatatttcagaacttgattttaaaatccagaaaataactttacatttatagaaccgcagacattttcttccagtatttaattagtatgaccacctcagaaatacaaaggcaatgtatttgtattagataaatgccttaggataataataataactcgtgttatgcctaagtaagcatgtagatggatctaggcaataaattttcaaagatgatgaaaaataaaatatctattattataaatacattatttttcccatagttaaatgaattcctaaaataacatcggaagtcacatacttcttctgagtactatttttttaatgttttcttgatatttctaaacagttaagctcataattttaaaggaatcatttataaacatttattgtatatagttagatacatatatcaacagaaaggacagagagagagtaaatagaaactgacctcattcactgtggcatagtagctttcatgcttgaaagtgggtgagttgtcattcctgtctctcaccactattcgcacttcatggtagataatagtgcccacttttttgttgatgcactggacctgcaccacaatggagtgtatgttcatcggtggctgcaatgtagaaattgcatcttttaaaatactaattaaaaacaaagcttctcatcactgtcaaagcactcgttcattcagtacatttttctattcttgtttatttttaaattataataatctcaaagaaaatgatcattttaaggacaagagaagacaatcataattaatttattgtttaattttgtatctcagcgtgtggaattcaggtagcattatgctcacagttagtggatggctaatgagcgcacccacaaaattaatgcttagaattgatgggattaaacgaagtttgcccctccaaagattaaagaagcaataatataaacttttaatttgaagaaagtgttaattaataaattcctggagaagagagattgtttaacttttatgtttatttatatttttgctggaatattatatgttcattgctgatcaaattaaaaatactgattaccaaaagagaaaatccaaaagccagccaactaaacttactcattctacacatttaaatgcttattttgctaatctttttcactctctaaatatgtacatattatagacacacagacacacagtgaatatcagcccatgtttataaatatagatttactatagcattttttgtataatactatgaagttatgttatgtgacagcaatattatacttcattgtaagcctatagcataatgtatccaagtaataatttaaaatgaactactccaggctattatattttgtcattataaaaaatacttcaatacatagtatacataagcatatgcttacttatctaataatttttataataaattccttgaacgggaaaggtcaaagatatacttcctcaagtgccatggctaacagtttgcagagctggaatgcacacctacaaatatttgactctagagtcagagtattgaccactacaaagtatttctttgtgatttttaaccccttttgagcttatgcaactttatctctaaatatgtcatttttgcagtgtcctatcctgacccctccatcttaaaaaccttgtctccaacctgacatctcctttcaaatttcttccaatttatttttctttattgcatttctcaccgaaaatttggctcgttgtatattttatgtacttgttttggtttgtctgccttcactagactggaagctcaatacaacctgtgtgttattttagtcatgatagtatccctctttccagtaaccagccctatgcctaagacagatgatctggagtcaaactgcatggcttccagttccataacctactaactgtatgatccaggaaaaagtacaaagtatctctatgcttcgtttattcatctataaaattaaggctaatagttacaccaatgagaattgtaaatactgcatgtgattagactatactaggcatatgttaaacacctaagggattacatacatatcctattttatttattaaaaaataaatatccaaaatagtgaaaaaataaaatctataatgcacgacacatttgtaaatgagaaaaatgctacagaaactatatctaagctgaaggaaatcattatttagtttcaagatatttttatggccaacaaagaaaaagaaagttgacttgaatttgtagctgtctgaatgatgctacctagaaagaataaattgaggcatcattgacatacgaaaagaggtctctagtgaaatcacacatagctctgtgtttttatatctactctatttctcctttaatcactgatataaatgaaggcattaaaatcatgtgtataaaatctgtgaatgttacaaaccttggaaggatgtataaatacatttaatgacaaaagacatggttcaaagtcatcttaataagtcataataatgggttacaaaatggtaaatttttgcaataataaattttatcctccaatttgtaatagaaaaaaaatcacccaaatgtaatagacagctacaaacattaatgtaaaaatgtaattgtgaaattttgatagctaaaagctgattttacatgacagcactgtaaatgggctactggaacactaatgcatactgtacattaattaataatatcagataataatatataggtagattataacaggtaccattttacaggtgcatagaagagaaatttgaacacttttgagaatgtataaaatgggaggattttaaatttaacaacatatgatttgtcaaatatctaaatggttgtcatggaaacatccattagttgacttactgtagtttcagagagcagaaataagaaaaatagttgaaaaatatttcaaagcatgttttcaccataagtagagggcttctcttaatccaaatttgcaccaaataattatgtgcctctatcaaagtatctcatgtaactcatatgcacctactatatacccataaaagtttttaaaaaataacaaatagagcagagattcttatcagtagaagagtatagtttatgttagaaataaatttatgccttcgcacttccaaatacttttcctctgccattatgagctaaaatatttgtgatgcttcaatttctttttttcacatttgtctttgtataaaataaagaaaaatcaggaggaaaaagtgacatggaatagaacagactattctataaaacaagacccatcactgaaatatgccagtttgaggataaaagaccattgaaaaagactagctcttagaagtttcctggaaagaatttgaattagatgacctccatttttactaccagctttcaagtgtgtaatagaccttttaaggcatgtccagcatattttaattgtaaattaaaaacaaaataaatatgtgtactgtttgtccttggcacacctcttggaagacaatgaggtgaattatgcacttttaaagttatttatcttccaattattgcaagagagacctataaaaacattctatctcaacttctaattctacttggagtggtaccactgggaccaaaaggtcaaaatcttatcaaatagaggatcaaatgcactgtgtactgaggcctcacttagtcctgctaagtacccataaattagatctaaccaggtcacctggaacagttatcactctcaactttagctccctatgcaactgttagtggcatggctagaacttagagggcaataaattataaccataatggatcacaccgaaggcaaaaattccctgtggctaatatataacacacaatgtaattttgtattggcatagattcaattctgctgtataagaaggtcatacataaaagtacagttctaataagtccattagtgagagtttagggactctaagatgcttaagaatgcattagggaaattttgctttatctttcataactggtggcaaaaataagccatggtaatttgaccttttctaattttctttaattgctttattcatcaaacaaagaagaaaaaaaagctaggtagaaattgtgttcatataactatttaaaactattaccattcatatatacctaaacatgcaagctattctttcaatttaaaaatgagtgcttaacacaatactctgaacgtatacttgcacatttgtgtattagtgtacctgtgtataggttatgatatgtgtatcaggaatgatatatatcaacaattaaaggatactatcattaaaaagtgggtttgagagtatgaagagaaaaaattttcccacaaaaatgtaaaaattttgtaactctgaaaaagaaaaaaatataaaatagaaatttttgttatgaatttctcaatcatttaggattcaacatgaaaattaaagtttttataggggatttgttgatattagcagtttagattatagcacaaatcttcaatccaatatattttttttctagaaaccaaatgatttggaagtcaatgatttggggggcagggaatgcatttttggcaaatctgtaggaatttatttttcataaagtataggcaaagtttgtctaattctcaggagtgaattttttttgtcatgatatttctgtctatggacttaccacctttataacataatcattcctatttcacaagtaatgtggaagacagtgaaaggaaataagacactgtgtgttttagaaacgacttttacataaaaaagcaaacttaaaggaaatggctggccagagttgtcagtgtccttcacaaattaaattttcacaatgaatagtagcatatttactgaagatattacctaaaaagaaaatatcaatttgtaaatacaattatgcatatgtgacatgtagatacatctatagatttttcacagtgaattattaaggacattcagtctatttaatggtaggtatttgttatatgaaaagtttaatgtgggttaggattaatatgacttagtccttggatactaatagcaacttttataaaactgatatgaggtgatcataaataaagtcagtcaaaaatactattaaataatatggattttagaacaaggaattgcataccagtgttattagaaaataatttatacagaagcagcatttaagatatctcttagtagcacataaaattcaactgatagcactggataacagtgatttcaaagtttatgttcaaaagaacatcagggaaggtatggtaagaaaaaattggatatggtcatgggacaataattacattagttttcttagtttgtagttcatacatttctaaataaaaagaaaattatatagacagggtgcatcttgaatctagcaaaactcaagagacagatagaaaacagtttgcaatgaaaaggtatctgtgggcacagtctctgtttcagcactctggttgtagaataggttgaatcaagacaggtggtagacaacaattagtttatatgagtgatgactaagaggtcttatactaaagttatgttgactgatggagatgcaagatacaaggtggagataaaactactaaacttagcagttgaatggacactggcctgggcaggggagtcaagccccttttgcagctaccaagttagagtctgaaagaaaagaagctaagatatttgatgttgttatgaacataatttctctcgtttcaaaagcttttaaaattttgcccaggattttgagataagtattataggactgtaccagagtcatacttttctttctgttattattttaattattgatattgtcatgaccattattatcacatgcccaatagtgatgagagcattttggccatgtgagacaatcatttagcatttcaaaatttttatgtgatgtgcctttattactgagactcttcatgttcaccccaaatatcacattctggttgtttctcttttgtgacttttaattttgtaactcttcctttctttttttaatttttgggtgctgaaaatttatgtaactttagtgaacaaaaaaataaaaataagacataaaaataaatgatgaccataagggaaaatcttataaaccaagttttaaaattataaaacagttcatagtcatacaatctcatgtaaatgctttctaattaaatacaaatatctgagcgttgggtatttttattctttatattcttcctcggaaattttcatgaagatcatgtttatcagcttatttttaacacactgttaaaaatgtttctgtctatattgtttgcttttaattctattacagccataattattcaaacgtccccattaagagacagtttattgcctcaatgagaaaatgtagaaaacatgatttgcatcactttctctggaaaataaatttttctctaactgttgctaaaaagatggtataattggatatggatctaccatgtggccctactccttgctccctggctatagattcaaaccagtgagtatttaattgttatttctctcagaaattttaaaacaaaacaaaacacagtgactttaagccttctttaatggccactgcatcaaaagtttatgaagaactggcatggcatgaacacagaaaacacttaaagtcaaatgaaaaacaaggaagtggagtaaaattataagtgtataaaggaatctgctctgcagagagaaaaatagagaatatgcacagagaaaggcagaaactagagaccatatggtccaagaccaagtagttttcctctctccctggtaaacatacaatttccataaaagtaaattattttttatatctatgctattggtattgttaatattctctcccatcagctggaaatcatttgaaggcattgttgtgtcttccttataagccaaataactttgattaaaatcagaatattcttagaaaagcataatttcataacaaaaattcagtggaaaattttctataaaaataatttcaagagcaatttaccactaagaagggttaaagttaattataggctagtgattataatacaaagctttcgccattgttagtaggatcaaactcaaattgttggttctattttgatattcagagcatatatatatatatttgaaatggaatatatatatataatatataaataaaaatatatttttgaaatggaatatatatatataatatataaataaaaatatatttttgaaacggaatatatatatatatataattttttttctttttgagacggagtcacactctgtcacacaggctggagtgcagtggtgtgatcttggttcactgcaacctccgcctcctgggatcaagtgattcttctgcctcagcctctacagtagctgggattacagggtacctgccacaatgcctggataagttttggactttagtacagacgggttttcaccgtgttggccaggctggtcttgaactcctgacctcaagtgattaactggccttggcctcccaaagtgctgggattacaggcatgagccatcacacccagcccatattttttattttgattcattatattcataaaagaacaaccaaaaaactttgggcaacaatcaaaagaattacattttaggtaaatgccctatattttaaaagaaactacaaatattttggtatttatcataataatatagttatttaataataatgtatattttatctatatttagcttttgggaaaaaacattttacattaaataaaatttaaaacagtgtaaataaaggtatatatatttacatatatgaatatcatagtattaatatatatttcattaatactggagagcatattttcaaatacaatctatataaaaagtgtgcactcactttttttaaaatgaattctctactatatctttgtagaaaatattaactaggatcatagagaagcatacagaagaaaaaatatcttattctatatcaatgtaaataatgttaaaacaataaagtaaaaacatacaacacctctccaagtaaactaagattatttcaaatatttacataatattattattttatttcagacattacaattatttagcaatattggtatggaagcatatagggacaatatatcgagaggaccatttagtaaaatggataaaactccctagtccagtaatataatgatggtaaatgaatttatctctataaaacaactaaacaattgtagaaagatgcatgtacaaaaattttcactgcagcatttttgtaattcttaaaaactgcaaacaaacttgacttccaaaataggagattcattttttaaaaatctcttatttattcatgcaataaccaatcatgcagctaataaaaataattatataaatatacatttgtttgcattataattttacatgtattataaattttatgtaaaaagtaggccgacagcaaaatgaacagcataatccaatttaaattaataagtattataaatatacatatcaacacacataaatgcttgaaataaaatgtggcagaataaacattaaatgttattttccctaactgataaaattatcttcatatatatgcttcttattttctgatatgtttaccataagcatatattattttacaattaaatgagactgtaatttccagtagtgattagatttggactaaaagcccagatttacctcactatttgtctagcagtaatggtctataggacacataaaacagatgggcactaggttaaggatattcagaataaaagcccttatgctttgatgaatgaacccctaaaagcactgtggcagcaggaaaacataattcacaagaattcaaagaattcataagtaataaagcacatagtaaactgtagtaaaataagaggcaaattgagatttattaaagactccaaattttagacatgaaatagtataaagtatcaaccactccataacctattgtaaagtggatcataaaccctgagcaatgatgtgaaatgattcaggttcactaagctgagtatctgacatttggatttcataagctgggaacttgtgggtaagcatgtttagagttactctctgagttttcccagggcccagtgcaattactgattataatccactaccctctgcccctctgtactcaagaaagactgagatgcaaataagtgagtacaaagttactttagagagctacttatacctattaatttttttttaatttttccagaaatgaaacatccaactacgttggtaatttagcaatttttttttgaggtagtgtctcgctctgctgtcctggctggagtgcattggtgtgatcatagttcactgcagcctccactccccaaccccaagctcaagggatcctcccaccacagtctgcagattagtgggactacaggcacgtgttaccatgcctgcctagtttttcaaattttttgtcaagacagagtcttactctatttgccaggctggactcaaactcctgggctcaagcagttctccccactgggcctcccaaagtgctgggattacaggtatgagctactgctgtgccaagcccaatatagatattcttaataaaaaaaaatttatgctatctgagaactacttgactggcatattaccatgaaactttttctcattttttttttcttttttgcaactatgtaagacatttccacagttttgcccttcaaccaatgcttactagttgtaaaagcaggctcctgtgagtgcacccaccaaactacatcttcaagccggcagctgagtgacacacttacatgttgccattgttggacagaaatgagttatagccatgcttgtcctactttgccaagggtaccacctcttttttctaagcactatattttcttcttgttcagaaattgacaagcttccaggatattaaaggggaagtctaacggttctccaggacacagatgttcccttcctttctcattcttctttaaatgagttaaagaaactgttgttgctatactcaggaaataaactcaaattatgtaaataattcaatatcatataaacacacacatagacatttaaattataataaacttatattacaggggcaaagaaaaaaaatcactaacatctctatccagaactcttccggtgctgttcaggaaaagcatttgcttaacaggatccatcaacacccagtaatccacattatcctttaaagaaagttctatggtggggtctggtcctccagcagtccctttgatcagcatgttgtccaccagaattgtacctgcaaaccaaagaaaggtacttgaaaacatattctactcatatgaattctttagcaaagatcatgctcttaaaccgcggctggctcacaatcagttttaaagctgaaaatactcaactgtatatctagcataagacagaaaatattctttaccaaaaggccaaagtatctgcattatattatttataaataatatttttggtggaaggcagagatacagacatggtgagttccatcatccattttgtgtttccctctaacaacataaatctgtttccccccatctatcacttctcacaggagttatcactgaattttatcctgaacaaaaggaaatgcctgtaatagcagagtctgatgtctcaattaattctgttagacctctgatgtgaaaaaaagatattgtgaaactaagaaaggaagaggaaatagatttttaaaaagtagctgagcctcccatggtgagaactgcttctttttatcttagagcaaatacataaaacatacatcttgacatgaaagacaaaactagtgtgcagaaatggaatagaagccattcttctttaagacatgtctgggttactctactagaacaacgcactaggccagtgtaacatttcagtgattgctttcttattattttttttcagcaagctgaattgtagacagtttttgaataaaacttgaaaagattatgtctctaaccctttctactgtgttaaagatcccatgcattttacatgtcgaatgcaaacagcactgatgcaactcaaataccatttttccctcacgcagcaatgatctctttgccaaataataatgtaccatggcttagagcaatcattttcaaccgatccattttattaaacttatagatatagaagagatgtggctatgcaagtaaaatgtagcctccaaaaaaacactagaataaatggcaactatcgagagaacacatcgccttaggacagcactcaagaatatacagagaatccataaatacgaatctggcttgaaaaatataacgaaaaaagtatctgttgcattttcttaaggcatgaaattggcctaaatgttataccgttgcataattacaagaaaagtggaaggctctttaaaatattttctcagtaatttaataataactataattatctataatatttctttatcatactactactaccagtctttatccgcctaagaaatgctggaaagaaccatgaatcttttgtaacaagccagaataatgtttaaacacaaatgttgtctcacatacacatacttttgtaaatggcacattttttgcactttttcacatactaggacataattacatgaatattgagtggaatgagtatttttatttttgactgaaatggcaaatacacaacctacatacaatacactccaaagtatagatcagatattgatggcattttattgcctataaatatgttcaagaatgtatatatattcaaggccccagtacatactaatttacaaatacttcacacaactcaccatgaaaagatatttgatctgtatttcaatatataattgagaaattgaaagggaatttattttctcatcaagaaaacttatgtacaataggcaggtcaactaacattaacattaataccttgactcaatagtgtttaagagtagcaactgcaaatcttctgattgtgtgtatgcatgtatatatatatatatatatatatatatgctccatatatatatgctccatatatatatgctccatatatatatatatatatatatatatatatatatatatatatgctccaagctgcgagcagatacactaagggaaggagccattgaactatctttacaaagcaaatagtttataaccagataaagttttaatagtaactaatattaaagtagtgaaacaaaaacactgtatctggatttatattttatttaaagattctaactttcatggaaaagatctatagttttcttgctctcagctcactcctgagttcaatgattgaaactcaacaaaaaatctttctactgctggtgtgttgaaagagttttgtttgcttgcctgctttcccctttagaattgtccatttgtattgccaaaaagaaaaaaaaaagcctctcaaattttcatatacaagcttgctttaagccaaaatttaggggagagagagagaagagagcaaagcttaggcagacatgatacaaggagcaatatacatattttttaaaaattaacctaagtgttcactctgaattgcctgaacaactgtgcccatacccctctccttagaagaatacgtgacacccaagctatagttagcattaagccagaaactcctgtctctccctatcccagcagtggtgactgtatctttccacacatcctaagttttcaagatctgaaaagctagtgttctagacaatattggcaagcagctaaacaccagaatactctgggtgtattgggataatgtgctctctttcctccttcgttactttgcaagcttccctttttgccaataaaccttttgcttaatgtgtttcatttgatgtttaaatgtattctcttctttgacttcattttaaatattacagataagttaaaaataaaaagatgggaggcacgacacaacactaaataagaaaactggatggctctattaatgtcagctagaacaagcaatgtttaatagtggtaacgagacatatttaattataataaagggatcaacaggaataatcctgagtaggcctgtcttgcagaataggtaatacccaagatgggattcaccttacatgaaattttcctttcatcataataaaaatggtggcagttcagaaaatggaattaaatttagtttgatactcatataatagaagttaagagagctggccctggaatggataggcttagaatccaatccataatccaccacttaccaactatgtgaaagtggataaccgcatttaccctcgatttttctccctacaaaatcagtactataagagaaaaggcatttctactataatactatatgtatgttcctgaaaaagacttgttctcttgtatttagaataataaaaatcaaaacaatcacaatcgtgttaaaaatattagcacagttaaatatttattgacattttcaacacatttcttggctggtcaatcttttacagccttaaatactgggatttgtgcttcatcctttaagaagtaggtattgagggccatttacctctagggacgttttttataaaaatggaaaacttcctctttcatttagcctctttattagcctattaattcagaaaaataactttgcagcttctttttatgtacttcctgattctcaagagagattaacatattaaattacaggagttcatgtaactgctaatatagactctatttgtacagaataaatgttcttcaatagattttccattttttcttaagatcttctcacatagctagccctttctttttaattgtgacattagagcttgccacccatacaagaggatagtgggcattaagtatggtccaaaaaacctgtgacatgcttctaccccaaagaaaagtctatgtttctatttcccatgtatatgattatgtggttacataacatgagattctatgttgtatacatgtgtctatgtgtctgtataacatgagaacacaaactgtgttgtgttctgagtccataaggaatacataacaacctgattgaacttggaagcaaatgcttccctaaccatgtttcagatgaaatggtagccctgacaattccttgattatactcttgtgaaaccttaagcagagtacctggctatgctgtgtctggactcctgactcaaagaaactatcaaataataaatgtgtgttgttttaaattacctaattttaatgatattgttatacaataacaggtaatttacacaggatttaatgtcaaaagatctatgttcagaatcttggccgcacactattaactaactgtgagcttaagcaagttcccaagatttttacaatcagcaatatagagttctatgagaaaacaataaaaatgaatgtaagtggaggcacgcaactacccaatgaataacatttttcatcctacagctactagcaatttatatagatttgagcatataaaggagttatatattatttttcattaaattgggaacattatcaacaaaatgattttaaatgtaaaatgtactttctgtacaactgaaataagagaagcacagaacatacttaaataccagcaagaaaaaaaaaagactatgtatgcatatgtaaaatataaaacaaaaagaaggcaacagtttattcacagtaaccgttgataacttttcatgaaataaaaggccatttcttgctggcaaaagcaaaaatgaacaagataataagcaaaaaaagtcatactactaagatcaaaaatgcttattagtacttattagcatttgctgactgtattaactggactaagagataaaatagaaagacgttcagggaattaccatatttaattatcagactggtgtaaatgggaaaggtttataccctcagaatattgcaatattttattattttcaggccatcaaattgctgcagttaaaattaaaagtacaagcataccatgccgtgtatgtgtgtttttgtgtgtgtgtgtgtgtgtgtgtgtgtgtgtgtgtttcaacataatgattaaagtgggtaaaaaacaatcttcataccccactctcctcaaccaaaaaaaaaaagaagagtatagaatctaatcaggcagttctgttcattagaaaaatatgtcccaggggttgaaatcaaagaaacaaatattggttattttattttattttatttttgagagagtcttgctctgttgcccaggctggagtgcagtggcgcaatctcggctcactgcaacctctgtttcctgggctcaagcgattctcgtgactcagcctccataatagctgggattacaggcacctgccaccacaaacagttaattttttttttttttttttttttttttttagtggagatggggttccgccatgttggccaggctggtcttaaacttctgacttcaggtgatccatccgcctcggcctcccaacgtgctgggattacaggcgtgagctactgcatccagccaaaaatatggttttaaaatgtatgtgaaagattgatttgaaaagataaaagccaaaaaagccctgcttgatgaaaaagctcaacctcttaacctgtgtctccattagaatcaattataaacctcaaattttgggtttttcttccattccctaaccaaacaattaaatctctaccaagctgaagatccccccccttttttttttttaactaaaacttcatttcaacttgtgaaattcctttttttagtgaaaatgcaactgtagaaagttgttgttgttgttagatatgtgatttaaaatataaactttttgactgcgattttaaacactatttcaaagttttaaatgattcgattcagtaaatttgtaagtgtgatttattagattgaaagaattgattaagtgtcttaagaaaaaaatcctcttgggtatgcttgcctacccttctagatgtttgaagagtttgtattaaatttatcaacatcacagtagtttaattattaaagattgcatatatagtactttggataggggaagtaagtttgttaagcttatgagttaatagaactttaatcacagaacaaattaaagttttttcccttagtttttcagtcttcctacggttatagcaggaatgaaaatatttacgttatatttatggtcaaatacgattttgattttatctgtgtcatttacacatatttaatattagttaaaactcaagcaatattccatgaaaagacaacccacatattcaaaaaataaacaaaaacacctaattgactgtaggacaacaaacaattatataagacaatatgtttaagaaatggatgtggaattaactggtagtagtgaatcaatgaacatatttcaacaactccatttatttcattttttgagtttctggttgatccaaatccaagtgtatattccaggcagagagaaaggtcacatcataatcctcctccatttctcctctgatttcagatttaatttttaatataagatatttaaaaccttttattccatagataaatttgtacaatagaaaatgtggttttttagtacctctaggagaattctgagttgtcataaccctacagttaaatctgttttctcacctataaaatcattcagattaacaattctgtaaacaataaggcaaaattatttaatatgttattgaaaataataaaacagatggatgttatgacaatactaaatgtgaattagaactatgttacagaaaaatgttttgtttctataggtaatttgcttctggaaacaattaattggaggacatatttaataaccatacgtgctcaagcagtttgcttttttcatgtaaaagtgggcaagtattaagactaaattctgtcatttttttctatggcagtgcctatcgtagaaaaacaaataagcttaagtttgataattaaagcagcaaaaatgtaattaactaaagagtactcaaatattcaaagttttctgataggcttatcatttgagaggttaatccagccaaacaaatttaatttaaagtactctctaactgcaaatgaagtaaactttctaagtcatattccttttcaatagcacaagtacttgccctttttaaaaaatcaaataaactaactaaattaaataagattctttcaggtattttctaaaggtcattttattcatttggtctgtaagatgatgaaaatcattttacacattgaagaagctatttcaaagcctgacgaagtactttactttcaaaaatattttctaataatcattgcataaatgtttcacctccttggttaaattgattcctttgtgttttattctttttgatgctattgtaaactgaactattctcttaatgtcttttttagcttattacttgttaggtatacaagtacaactgatttttgtgcattggttttgtatcctactactttgctgaatttagttattagttgtgtgtgtgtgtgtgtgtgtgtgtgtgtgtgtgtgtgtgtgtagactctttagggcagggatgtccaatattttggcttccctaggccacagtgaaagaagaattgttttgggccacacaggtaatacactaacactagcgacagctgatagctgatgagttacaaaaaaaaaaaaatcccaaaaaataatcttatgctgttttcagaaagtttataaatttttgttgggccacattcaaagttgtcctaggctgcatgtggcctgcggatcataggttggacaagcttgctttagggttttctatatgcagtgtatttaagaaagaggaagattgtttaacttcatataataataatcagatacttgaatatgttttattatttatacataatattattcaaatattaatcagagaaccacctgaaagtgattatctactttctcaacataactttttcccactataaacattcattgttatgcagaatatataaagaacttctgaaatccaacgaaaaacaaatgatctgattgaaaagtgtgtaaagaacttgaatcaatagtttttcaaagaagatatacaaataatcaataaacacacagaaagatggtgaacatcactaatcattggggaaataaaaatgaaagctacaataataaaccacctcacattcattaggatggctactagacaaaaaacctaaaaaatagcaagtgttggcgaggatgtggagaaattgaaacactacaatgttggttggaaagtaaggtggtgcagcccaaaatttcagttacacaaaagaaacaagttcaagagattaattttacatcccagtaactatagttaataacaatatattgtacacttgaaaattgctaagagagtagattttaagtgttgtctgtacaagaagtgaggtaatacatatgttagttggcttgatttaaccattctacaatgcatacacatatcaaatatcatgttttacaaaagaaatatatacaatttttattaataaattgaaagtttaaaataaaatcatatggaaattgtggaaaacaaatgtttcctcaaaaattaaaaacagtattaccacgtgattcagccattttacttctgagtatatactcaaaagacttgaaagcagtctctggaagaggtacttacatacccatgttcctggcagcatcattcacaatagctaaaacttggaagcaaattaagcatccatccatggataaatcaataaacaaaatgtagtatatacacaaaaggaatattattcagccttgaaaaagaaggaaattctgacacatgctacaacatggatcaacagtgaggctggtatgctaagttaaataagccactcatgaaaaaacaaatatggcatgattatacttgaaactgacccaatacttccatatattttttaataaacatagatgtgtactcttctgatctgaaagtttgaaatttaccaaatgatcttcaggcctctcaaagtatcaaaaaactcaccatatcaccacatccagacaatgagatgcaggatccctcattcattatgcttgcttccttgcccctctgtaattcctgtttcttgcacattattgcatttcttccctgctatataaacccctagttttagtcagtgagggagataaatttgagacagctcccatctcctcggcagtatcacctgattaaagccttcttccttggcaatattcatcgtctcagtgattgagtttgtgtggcaaacagcaggacctagaccaaatccctggtgttttggtaacacacttatatggggtacttaaagtagtcaaaatcattgacaaagtaggttgttaccaaggacttggggagggagtaatggggagttattgattaatggtatagagttttagttttacaagatgaatacagttctggaaatggatagtggtaatggctgcacaactgtatgaatatacttaataccactgaactgtacactcagatatgtttacatctgttcctcttgcttcacttgtccttatcgtatttgctacaaggcattaggatcaattatcccccacaagtatggaaagtcttttctctgttcaaacgttcatcagcatgaagggtccaaaaatggccagaggacaatctgagcttccaattagtcagaacaatagttgagtttcgttgtcaaagcgttcaacttctggtcctagaacccaaatgtcacccagctgaaggtcacagacaagaaagccaaaattattcacgaagatcattaagtaagataggaagagagatcactttcatcttcacttcaagttgcccaggctctgttatgtcatgccatctcctgcatagctattcaggagagggcatgccttcgtgacctctaatttaaagcatacgccacatactgtaagagaatgaccaaacctcatagaagttcatcttctactagccgttatctgagaattaagaattctatcccaccatcttcttctgctagctgcttctgaatggtaggcattgtagtaacattattggattaagctgtggtgtgagctctttgctatgatccttcaccttaaaataaaataaatcaccttgttggaaatgaggttgtatgtccaccagataatgatcaaaagcattggaaagacgttctctgagcacatgaatgttgtttcaggtagaaggtctacagacaacacaaatccatactgaatcatatttatccatataaggaccctcctccatgataaaagtgggtttaatgccactggtcagtgagctggttccctgaggaatgataccataatagggattcagatttgggttctattactggcacattgagtatcagcaacagaagtaaccagattagccttagtaatgctatcttcttgagcccacatattaatcccatttaggtcactatgagcactttacacacagggtcatttatttatccctattgagaccaggaagcccattctgttacagcgtccctcactgacatccctaatctacagaggaaaaaaaaacaaaacaaaacaaaaaaaaactgtagggctcttcaaggaagccagatgcccttttaccaatatacttgttaaatcttgctgaagtgcatgtcctctggttatcttagaagtgtatagataaaggctggtttatcagattacacatgaagataaattcattgcacatttccatcactctgaacttttaaactcctctaaaatagggcttctcaattttaatgtgcccatgaatcacctagagatcttgttagaattataacttatgatttagtagatatagagtaggagggtagagccgtctagttgatgctgcttgtctgtgtgtctcactttatgaaagcaggctttatcacaatgtttctaaagtgtggtcccctgacataagtatcatcttcacacgagaacttgttcgaaatccgtatttgcggctccatcccaaactattgcattagaaactcagagatcccatttcagcaatctgtgtttaaatagccatccatgaggctgggaatggtggctcacgcctgtaatcccagcactttgggaggccgaggcgggtggatcacttgaagtcaggagttcaaaaccagcctggcaaacatggtgaaacaccatctctaataaaaatacaaaaaaaaaaaaaaaaaattaaccaggcatggtggtgggcgcctgtaatcccagctacttgggaggctaagggaagaaaatctctggagcccaggaggcagaggttgcagatcgtgccattgcactccagcctgggcgacagagtgagactccgtcttaaaataaaataaaataaaatagccatccatatcattctgatgcttgttgaaatttgagaaccttgttttataatgtgctgtaaaagttcagacattttgacttcattaactataagctattattgagacttggtttcagttagccaatctagcagactattaacgccacttttcattgtggtagccaaaacatcacaccctgaattcagggtgaatgcattcatgcaaaagaattcagcttcagcaagttttgtattttgttgtccattgtctaacgtctttagaattcactcccatgcatgatttctagctccctgccaatagtgacaatgacctataccttttgttttgttttgttttgttttgttttgagacagtctcgttctgtcgcccaggctggagtgcagtggtgcgatctcggctccctgcaacctctgcctctggggttcacgccattcttctgcctcagcctcctgaggagctgggactacagctgcccaccaccacgcccggctaatttttttgtatgtttttagtagagacagggtttcaccatgttagccaggatgatctctatctcctgacctcgtggtccacccacctcggactcccaaagtgctgggattacaggcgtgagccaccgtgcccagccaacctatacctgttttgtagtataggctatcttgttttaaaaaagatcttatattcctgtcttgactaaaagctaacatttcttatggccctagaatcaatgagagatggtataagtgggtcatgaaaagaattgacattagctcttgaggaaactgtccaaatatagttactgtaaggctattaggcagaagaggactagagaaagtgagagggtctatgttcactagccagaaagttcatgaaattgagatattcaatgttttcaccattatcattttcccatctcatgtctcaatgtcccttttcttccccagtgccaattttcagtgccttttctataggttaagaggatcaaaagggttgagagttccaagtatgttgcatctctgcaacacttataatcataaaaagatgggctccttcaaagctgccctgatgaccttctgtttccccatgtgctcttattgcattttatacctgttagtttacattttccctatatacattctcaagtatatagagaatatacacttggttgtcatgagaaaccaaatgtaataataattacaactattgctacagtgagtaattgctgcagccacttgatcatccaatactctatacctgcactcatcccatgccaccacaggtgtcatttgagtaattgtgatgccacacctggcaaaaattagccacatgctatgtgaatctcccacctccacgaaaggagtttatgcatggatccttaatatgcacactccaatccaagaatctcattttgagttattttttttttcttagagacaagtcaagcaccaattactataatacttggtgtaccagcaagaaaatgtcaccctcaaatttagataaaccaatgtgtttttagtaaaggaaagcttaagagaggtgtgagtagggtataggggaactataagaggtaatgtcatacactgacaaacaaggaatacagaagaaaaatttcatcaggaaaaaaaaaaaacaacataatctaatggggaaatgtcatataacatgagccatgtttagaaaagaaggcagccagcttggagagaacctatgcaacacatacctggctattatttacctctttcccttcatattctcctttctttgcccatttgtggaagccaactgaatgtcagatggctcaggagccttctgatgcaatccatgcatctctgagaaggtgaagagtggatgtaaaaggcaaacagatgtatctgcacattacctcctcaaggcattgtcttctgaattggtcttgtcaagagaatctcaatcaacaatgggatatagattcgggagaaattgagaggaaatttatgagttaaagcttaagtgattggcttaggaaagcaagtgccatatagtgtgaggcataataacactgtggtactggacattgtttagttgtagtttcctttatgtgtctgtataaaatcaacttttagttatataatttgctctatagtacaggtactttgtttcaatctctctctttccactataagaattgcatacacatttgaaagctagtttaatttaaaaaaaagtactaatttggccgggcatggcggcttacacctgtaatcacaacactttgggaggctgaggcaggtggatctcctgaggccaggagttcaaggtcagtctggtcaacatggcgaaacccatctgtacttaaaatacaaaaaaatttggtaggcatggtggtgggcgcctgtgatcccagctacttgggaggctgaggcagaaaaatcacttgaacccaggaggactatgttgcagtcaggctagattgtgccactgcactccagcctggcttgggtgacagagtgaggctgtctcaaaaaaaaaaaaaaaaaaaaaaaaagaaatgtattaatttattagcttttattgtgagtaatgaaagattatacttctgtccttagatcatattgatagtatttataacgttacataattctatattttgctccaaaaaaaaatctgtggccaggcacgctggctcatgcttgtaatcccagcactttgggaggctgaggtgggaggatcacttaaggtcaggagtttgagaccagcctggccaacatagtgaaaccctgtctctactaaaaatacaaaaattagctgggcatggtggtgcgttcctgtagtctcagatactcgagagtctgaggcagaaaaatcgcttgaaccctggaagtggaggttgtagtgagccgtgattatgccactgaactccagtctgggcgacagagcaagactcaggctcaaaaaaaaaaaaaaaaaaaattgcattgctgcaacatgagaaagctgctcctctagtcagagtatggctaagggaagtacatcataacttttaatcactgatatgtgattaaaattttaaagttttgataacattttaattaatgatttaagatgtttggctaatttccatctgaatttagattcaagcactttgcaagcctgttttaatctctatgcttaaaaaatctacatattaataaaatcagccttactacatacaagctgtcaacaaactctgttctaaacacagtggtggtatgaagtcaagtacctttctagctaatggtagtcagcttacacagttgttcaatggggcaacacaatcatatctccaactgttacagagattgaaatgattatcatctgaactactgcacttgtggcaaagttttctttctcaagaaggtttttggtaaaatacagatctatcaacaggagataccattacatttttagcacttaccatatcatttgcagagggatagactcagaatatgatagttgccatgaaaaatagtgaacagtaaaaactgaactaaatggaatatagaacacaagtattggaatgggaggcaaacgttaagaggaagagatatgggaaaatatatcaactcattattcaagcttatttaagcttcatttacatcacaaaaagtttccattcacaaccttttcaaataaaactgaaaggtttccatgatattttaaaaatataatctgtattttatcttaacaagaacttggaacaatattctatccaccattcctgatccaaacaagtgcccaatcttcatctatcttgcctcatattttcagtataaagagcccattcactttttagggaaaaaagacacaaataacacaatggcacaattgttaagtttctcattatatacaaccctatagctaataatgcacatgtcatttccatttctaggttgactaattttgatgggcagaagtgctctaaagtatgcttttataaacctcatatcacgtggtactccatggctgaaacatggcttaatgcatgttttaggatggtgaaggaaggagagaagggaaaaagaaaagacgaagaaaagaagaaagaaaaaggaaggtgaaggaaagaaagagagatgaagaaagaaaatgaaaatatgaccatgttataaagaaaattgaaaacatataattattttttcttaattttagcctgtgtagaaactcttaaggctgatgatgagatagatattttttgccataaattacatgaatctattcatttttacattcttattatatagcattagaatatgttgcattatatgtagactccttagaagatacacgtaaataaaattatcggggaacctgccccgatattcatgtaggttcttttctgtttttcctaagcatctgccagcttgagaagtaaagggacagagtacaaaagagaaaaattttaaacctgggcgtccaggggagacatcacatgtcggtacgttccgtgatgccccacaagccacaaaaaccagcaagtttttattagggagtttcaaaaggggagggagtgtgcgaataggtgtgggtcacagacatcaagtactttacaaggtaatagaatatcacaaggcaagtggaggcagggcaagatcacaggaccgcaggaccgaggtgaaattaaaattgctaatgaagtttcgggcaccattgtcattgataacatcttatcaggagacagggttttgagatcaactggtctgaccaaaatttattaggcaggaatttcctcttcctaataagcctgggagcgctatggaagactggggtctatttcatccctgcagcctcaaccctaagaggcaggcgcacctgggggcgctgtttataagcctatacctccaggtgggtattctctttcccaggaatgtttcatgctgagaaaaagaattcagtgatatttctcccatttgcttttgaaagaagagaaatatggctctgttctgcccagctcaccggtggtcagagtttaaggttatctctcttattccccgaacaattgctgttatcctgttcttttttcgaggtgcccacatttcatattgctcaaacacacatgctgtacaatttgtgcagttaatgcaattattacagggtcctgaggctgtaattacatcctcctcagctgacaggattaagagattaaagtaaagacaggcataggaaatcacaagggtattcattggggaagtgataagtgtccatgaaatctttacaatttatgtttagagactgcagtaaagacaggcataagaaattataaaagtattaatttggggaactaataaatgtccatgaaatcttcacaatctacgttcttctgccatggcttcagcaggtccctccgtttggggtccctgacttcccgcaacataaaataaaaaaaaaaaaagatgctttcaacttagtgactattattcctgtctatctctatgtgcatgtattacacacacacacacacacacccacattaagaacccactaaatattgttaagttcttggaaaatatgaccttaagtgaaatgacatacaataggtccttgaataacatagtcatttagatataattataatacgcaaaaaatggattttgttatgcatcgttttgattaaagtcacagtttccaagaacctactgatgacattaagtttatacacacacaaacatgcacacacacaaacacacacacacacctacacacacaaaggtagttatacacaatatactgactgccttataagaatgttttttctatcttgtaataatacatgagtaccacatttttcaatgcatttaatcatgctgtatctgagaatgtgacttattaagtcccataaatatatctaatacattttagagtataaatgttcaatgtattattgtagatataatatgaaactgtgcatgggagtggagtgaggaataattgaagaaaaggctcttgctgaaccaatttacctatgggagatcagaatatgccaccccaatttaggatggtttggcataaggtttgttgagctgaaggcaattaagaagcagatgaagaaaagctctctgcctctatttacctaaaaggacgatatacatttacaaagacaaaaaatatcccccttcccctctaaaccggggaggacaaatgttatccactgaagagaactttagactgttatgggcctggagatggcaccagaggaatctacattaacaagctttacttagcctttatctgccttttctttgccttgcctcaagttgctgtctttagaaattcaaaatccttttcctttgtcatgtcgcttccctaaaactttactgttctttgttgaacaatgcgttatataagctgaaattcaaactcacctccttggcggctactcattcccttgctgtcttccatgtatatatgaaatacacgtcaataaacttctctggcttttctcttgttaatctctcttttggtccatgggtccattccaactaatactttatcagaattgaggaaaaaaatattattcctcttccaaatagctatttagtattttctggctgacagagcaagtgtcttgacagagaactcacatttcattctctttccaacactcttcttttgatacactttaattataatccttaaaaatcagtctctgtgttagaagttgacatgatatatgaaggaaaagggccactttttaattctggaagttaatgcaataacataaagtagaaaaatagcatattttgaaatatatttcatgtcaaacacagacatatccttctaaaatgcagcatcaggaaatacttaggcataataacaaaagttcaaactatgatttcaaaacagagaatttgacaattcaagtatggatatgataagcctttattctgatttttttccaaatattccgacagtggaaaatgttcaaacaaaatttgaaggaggaggactgtgtactatcttattttccctcaatatttttcttatatactttaaagtaattttattctgcaatattgtgtcgaactatgaatttctcaaccattgtttctgaattgcaataaagtcaaaccgagcaagatggctttaatattgccctcatcttgacgaaactttaaacacttttcttcctgactgcatgtcctgacctttattttcttagagtgtttacttcagaaaattttccattgtaaattcttcctatgactctttgagatgtaaatagtctcccagccacttgtgagttttataacccagggatgtcttaaaaaacttggagacatccctttgaaatattgttatccagaaagatattttcccagtctcccagtttgtatggataataggagcctaaattccataagcaacaattaaacaattaaatgtggtccaaactcagggaacaaccttcccttcacttcctccaatgcttttccactaaaattttcttgcattgtgtttcaaaagaactgagttcaatttctatccactattgcaatagccttgaataaagtcttgcctgtttaactctatctggtataatttttcttcaagagaaccttaattagtcaagttctattttggcaatgggattcatattggaacttaattttatattataaaaatggataaataatcacaaacataaaatatgaatatatgtttccaacaacattgtgtgcatcaaaccaggcactaaatggcaaaggtataaataatcataataacaacttttgtggtgatagagttttttctagatgcactagatatgctgatattcttaaaataaaaattcttacatattagccaaaagatacttctgccagacaaatgttttattcattattacaaggattctagaccttttaaaattaagatattctgtttcaaagtcaatgtacaaattcccctaagttcttaaaaaataggggcaggtttcatggtgacctgttcaaagatctattgctgagatagattttagtaaatcaatttggttcactatcccagttggtcacaaatatgagtttttgttattacttcaattatcttattcattgcttactcaaaataccttttaagtcttatcccatgcagagatcagatggtaaggtttttaaagtaactatatgactatcagacttatttccatgtaacttgctttatttttgcctgtctttaagattttattacataaaaagtaataaaaattaattttaatgtattcctaaaatttcaaaatcttgcttgtttaaaaaaaaattagtcttaattaaaaaaacactatggaagaaaataagcctttaagtgatctatattatcctaatgatgttgttatgttacttaaatcaaaatttgtgaaaaaaataggttcacacttctgaatctcaaataaactttatagatcaaaaattaccaccaaaggtgctcagaaacaatgactaaaatttccatctctagcaattttttatataacaaaattgtcctaacaatactagctaataaattagagtttggttacaaaatgaaccatgataaaatctatcacagcaggaaaattttagaaaaggtcaagaccacttatgtgatcttaccttcaattttagaccaaggaaagtttgtaagtgaaatttaacccttcaaaaatgccccccaacatagtatcttattcttgtgcaacctggaaaaacaaaaaaaactgatattagaacctaggttattttatttgctgctggattatttgcttatttgttgttttaaatcagaaaaaaaaccccaaatattctggtagcctagaaataatcaatagccttgcagacaaccaagtatccgggttgccttatgaactaagcataggatagaattaaactagacactgctaaaatgaatggacaatttttagtggtatgtatacaaaccttaaagttcaaataatgtaaatggccgacatcaaacatattttctaaactatagaattttacaccaaacagtatgttctgccacagtaaactgtctctggctttcttaaaagtgatttattttatactgcaaattattctgtcatgtccacttggcatatatgtgttcctttctgattttctcaacaactctctcttagaaggaaagcattttctttttagaaaccattttgaatacataatcacatacatgtaacagaacatttaaaaagaaactgtttcagccaaaactatgctacctactctcagtgaagagagttgcagacaacttttgtaggacatggaaaagaagccactgaagttcagtgtgtaacatttatatgattaaatataatataaatataaataatataatgattaaagatgggaggctcaggtagcttggacactgaggatttgggaggaaagcaatattacagtgtgataattgcaagttatcaacaaagagtcatcagacttcttgcatttctccataagcttgatgacaagaacatcaggtgggtttctctgaaaagaactaaatttacagaagttagagaatttagagaaattagttgaagggtgtctgactttcacttgacaattttaaagggtgaaagtctaaatgaagaacttttgcagattaatggtctgcggttaggaaataactgtattccaactagagatgagtctcaagtgagtatttcccaccagcaaatgtgggccatgcaagagagtagacaagaaggagatgatctcaagcccagcccaagagaatcaccatgaggaatgaggagacctcagcagtaagacgctgggctgtgcagccacatccgcgggaacagcaaaagttagtgaccagaagacaaattctccagccatcccaggaattgccagaaacagctatccaaatttggaggtctccaaagaatctgcctacgtggttcacaatctcaggagttgccaaaatcagacctagagagtacagcaatgcaccctttcttttctttttacctctaatgctttttccagggtcaaacctggaggagatgaaaatcagtatttagtaagttgaagaaacagagatgaataaggcagagagagagcaaggttgttgacacccaggttctaaggcagctgggatgcctacaaaaggatatccaagcggaaaaaaattgaagtagatttctagccaaacttagaagtcctctgtgtctaatgtatttcagagtaggagataaagtatttgttggattagcacattagcaaaattatctagagaaaggaatacatgtgtaatgtccaataaaagccagtgattctccaattgaacataaaatggactaagttgataagaaatgtggggctctttcaacaaatagtttaaaatcaaaatcatgaaggtggataaaatatttctttacccccagaaaataaacggataaagctacttctactatctttgttatttttcactctactagccctaattatttcattactaacttatcatcaattgaaagttataaaatgcatgtttccatcatgatactatgtcatatatattttaaaagatggttataaaagtcatctgtcattattaaattaaattttgagtcaatatatatttgtattgggctatgaatatgcataagaaattaatattctgaataatatgtactctttcagtgccctggaaaagacaataggagcctgatacaatttgtcattcttgcacagtgacagttaatcgaaaattattaattcattatcaaagtatcatttccatgacaaagacgagaggaaaacatgcagactgtgtccagatttcttccagatatctaccagcaaaatatcaccaaaattaaacaatgaaagatagacgaaaagagaaaaaagccagagggagaggagagagaaagagagagaatgattatgttttacataaaaaacagtaaattgaattccttacttgatttttataggtattgttcatctagtttgtagtaaagggaacatagctatagacaggaaactgtcattgttgagaatttggagcttaaaagtattcagtaattttaaatgcaggacatgtattttcgaaaccattcataattaagaaattaaaaagattttagtaacatttgtgaaaaacagaaagaaaattatttaaaagtctttgctcttcagagatagtgcctggctcttgtagattcctttcacctctacactatgctaaaacctggctttgtctaaaaacaactttagctatagatggtcactttctgtaaaggcttttctttgttattgtcatagcattacagaatattgatgacttcaatatcacctacacagaaaaactgtatatgacttttggaaaaaaaatgagagatttagggcaagcaaagttatgctgttgtagattcaaaaaaaaaattgacattttaggttaagtatattttcaatgtttcaattataactgtaaatctataaatgctggtagaggtaacctcattagaaataactccttattctaagagcaaagagaaacctgaaatgctaaaatggatactcattcttaataggatcaagaaacaccaaatacccgtcaaatatccgaagattatattcaatgactctgaacaaggaaaaaagcaaaaaattaagtgaaacatgaatgaaagaaattacagaaatctaaacaaaggtataatctatattaatggattgtaaaactcagtagcttaaggatgctaaaatctcctcatgtaatgtcaataaaaatttcatcaattttgaataaattgaagaattaagtctaaaacatatacaattcaaattacaaagtatatgcccataatttatgactttactgcttaattctaccagcatataaagaagaacacatcttaaacaaactattacaaaaaataataggaaacacatactattttggtttttgatgctagcataaccctgataacaaacctgacaaaaatacatcaaagaataaaaagtacacatgaatatcctcattaacacagatacaaaaatacttaatgaatttatttagaaaataaatcaaatccagcaatctataaaataatgcattatgaccaagttggttttaccaagaatgcatggttggtttaatgtataaaatacataaaatcttattaacagagtgagggaaaaaaacataactcaaacaacacagaaaattcatgtatcaaaagtaaacgtgttcaagataaaaaatattaagcaaattaggaatagaaagtaacttcctcaatctgataagcaaaatatttacattaaagaaaacagaactaaattaaagctgacgggaagaagaaggcaagattatacaatcttataatttctattcatcatggtagttggaattcctagccactgaaataaagcaaggatcaatgacatatattaacaacaaagaagaactatgctcctatttagaaacagcatgatcgtttatgtataaaatattaaatacagataggccaccttttattgctttctttattagtttattgaactccataaatacggcatttttttaaaagtttgaagatttgtggcagtccttcaaataaatagcaaatttattagccattttttccatgtgctcacatcatgtctgtgtgtcacagtttggtaattcatgcaatatttcaaattttttcattgttatatctgttatgattatctgtaatcagtggtttttactattaattactattataattattttgggatgccgcaaaccattcccacattacattgaacttaattcatgaaatgttttgtgtgttctgattgctccacctactggccattctcccatctttctccatctcttcaggcctctgtattccttaagacacaacaatattaaaattagaccaattaataaccctacaatggcttctaagggttcaagtgaaagagttgcacatctctcaccttaaatcaaaaactagaaattattgagcttaatgaggaaggcatgttgtaaccaagataggctgaacgctagacatcgtgcatccaacagttagccaagctatgaattcaaagaaaaacttcttaagggaaactaaaagtgctattctagtgaatgcacaaatgataagaaagccaaaaaaccttattggtgataagtagaaagtttgagtgatctgaatagaagatcaaacaagacacaatattttcttaagccaaaacaaaatccagagcaaggacctagctctctacatagctatgaaggctgagagaggtgaggaagccacagaagaaaaattggaatcttgtagatgttggttcataaggcttaaggaaataagccatctccataacacaaaagtacaaggtaaagcagcaaccacatgattacatcaatagatgcaggaaaggctttcgataaaattcaacacacattcatgtcaaaaactctcaaaaaagttaggtattgaaggaatagaccttgaactaataagagccatatatgaaaaactcacagccaacattatactgaattggcaaaagctggagtatttcccttgaaaaccggcacaggacaaagataccccctatcaccactcctattcaacatagtattggaagttctggccagagcactcaggcaagggaaagaaaaaggggcatccaaataggaagagaggaagtcaaactacccctgctagcacaagacatgaacttatattcagaaaccctcaaaatctaggcccataagatccttaaattgataaacaacttcagcaagtctcaggatacaaaatcaacgtacaaaaatcactagcactcctggacaccaataacattcaaggatccaaatcaggaaatcaatcccattcataactgccacacactcacacacacacacacaaacacacacacaaacacacacacacctagaaatataattaaacaggaaggtgaaagatctctaccaaagaactacaaaacactacttaaagaaatcagagatgatacaaacaaatggaaaacattccatgctagtgaatagaaagtattatttttgctaaaatacctataatatccaaagtaattcatagattcaatgttatttctattaaactaccaatgacattcttcacagaactagaaaaggctattttaatattcatattataaatattcatatttattaatgataaaatattctattttaatattaatattcaggccccaaaaaaggacctgaatagccaaggcattcctaagcaaaaaatacagagctggaagcatctggctacccaacttcaaattatactacagggctacagtaaccaaaacagcatggtactggtacaaaaacatgcacatagaccaatggaatagaacagagaacccagaaacaaggtcacatgcctccaactatctgatctttgacaaagctgacaaaaacaatcaatggggaaaggactccctatttagtaaatgtgtagggagaactgacaagccatatgcagaagattaaaactagaccccttccttataccatatacaaaaatgaactcaagatgcattaaagacttaaatgtaaaaccaaaaactataaaaacccatttctctggacacaggaacaggcaaagatggcatgaccaagatgccaaaagcaactgcaacaaaagtagaatttgacaaacgggatctaattaagctaaacaggttctgtacaacaaaagaaaccatcaacagagtgaacagacaaacctacagaatgggagaaaattcttacaaactatgcatttgacaaaggtctaatattcagcaactaaaaggaatttaagcaaatttttaaggaaaaaaaccattaaaaagtgggcaaaggacatgaatagacacttttcaaaacaaaacatacatatgagcaacaagcgtatggaaaaaaatctcaacatccctaatcattagagaaatccaagtcaaaaccacaataagataccatctcgcaccagtcaaaatggctattattacaattaaaaaagtcaaaaaatagcagatgccagtgaggttgcagaaaaaaagcaatgcttatacactgctggtgggagtggaaattagtccaaccactgtggaagagagtgtggtgattcctcacggacctgagaacagaaataccatccgaccctgcaatcccattactgagtttatacctgagggaataaaaattgctctatcacaaagatacatgcatgtaaatgttcattgtgtcactattcacagtagcaaagacatggaatcaacttaaatgcccatcaatggttgaatggataaagaaaatgtggtacataaaccaaacttggaatgcggtacattccatgtgtaccacatggaatactatgcagccatataaaggatgagatcatgtcttttgcacgaacatggatagagctggaggtagttatccttggcaaacaaatgcaggaacagaaaaccaaatactgtatgttctcacttataagtgggatattaatgatgataacatgtggacacatagaggggaacaaaacacactgaggcctattgaagggtggagggtgggaggagggtgaggatcaggaagaataactagtaggtactaggcttaatgtctgagtgatgaaataatctgtacaaccaacccccatgacacaagtttacctacataacaaacatggacatgtactcctgaacataaaataaaagttaaattaaaaaaaaaaactaaaaattacatgcaatatttgtagtggtacaaatatatttatgtaactgtaaaaaagagagatgtataagaatatatacaaaatgtaataatggttacttccaaacaatacatgaaggctagaagttgaggtgttttttttttaatctgtaaggttttaattcttttaaaaaagaaaaagtattagtgtattgtttcacaatttttaaaaaatgtacaagaatgttcttatttctaccatattggtctgcttctttgtattttttctggcccaacccaaatcagtcttttcaaagtttatctacattggttagagatggagccttatagaacattgaattaaaggcagacatccaaacagttattgtatggaacagatctgcgtactaaatatgaatgtgtgtattgtgtgtgggcttatagtattaacaatacacattatgtctttttgttttttatgtgtattgtctgtgtacctgtgaatttcagtattcgtgagctatgcattaatgtataccacagttaaataaatgaattagttgcagaaaaaggaagatcaaagttggaaggctttatctatctgattttaagatgtactaaaaagccacagaaataaataaataaatgaataaataaataaataaatggactagaataggtaggaattagtcaactttatccttaagggccagatattaaatatttcaggccttgtgggacacatatgaggtgtctgtcactttttgcccctcttcctcctcctttctcctcttctgcctctttttctacctcttattttgacaatactttaaagatgccaaaattgttattagattgtgagccacataaaaacagcccaggagtcataatttggcaatttttggaacaaaggcaaaaaacagaaccgcagtagcctttccactaacacttcacaggaatttgatggatcaggaaaaacctttgtaacacatgatgctaggacaactgggtatccatatgaaaaacaaaagttaaccttaacccctacctcctaacaaacacgaaattaatcaaagaaggagcaaacgtaagagtaaaaggccaaactacaaagtatttagaagaaaacaggggattatcttcataacctgctatgaaacaacacagtaagaaacaaccataaaagacaactttaatatattagagtttcttaaaaatttaaaacttttattcttcaaaagatacctctacattaattataaactggaagaaaaatatttgcagaacttgtgtctaacaaacacttgtatgccaaatacacaaaactctatgacaactcaataacataaggacaaattttaaagtggacaaaacacttgaaagaaacttcctgaaggaatgtgcatgaataagtaataattacatgaagtgctcaatatccactgataaaaatttcttaaataggcaaaatgaatctatagtgatagaaaacaaatcagtggttgcttggggaaaaggatggagaaaattgattggaaaagagtacctgggaactctttagagtatttaaatgttttataccttgtcagagtggcagttacatgtgtgtatatacttttcaaagctgtatagttaacgttggtatatttcattgatttcaatgtaggtaaatctaacctcaaatatccataaatataataatcatatggaaggtcacttccaaattggtggaggaatagttgaaaaaatagtctaatattatcattttttaatctggataatggctccaggatagtttgttatggcattcaatttattctgtatatgactgaaattttaaaactcttaagctaaaaagcatttgtcacatgtttttgctgaaatattggttccttgtaatttctcacttaattcaagcagacatctaaaggtgatttattttccacccagaaaactaagagtacaaggattcacttgtgtccacaagggaatcaagtgatccaggagaacgtgcttcactattttttgcttttcctgacccttaaacagcttctaattcctcttgctaaaaaaggaaaagggatggctgggcgtggtggctcccacctataatcccagcactttgggaggataaggcgggtggatcacttgaggtcaggagttccagaccagcctggccaatatggcaatacctcgtctctactaaaaatatacaaattagtcggggtggtggctcactctcgtaatcccagctactagggtggctgaggcatgagaatcacttgaacccgggaggtggaggttgcagtgagtggagatcatgtccctgaactccagcctgggtgacagaatgagactctgtcaaaaaaaaaaaaaaaaaaggaaaaggaagcaaagaaaatagaaaagttacttcctctaaggtaaccctaggagttttcttcactatatttaggaacataattagctgtttttttaaaaaaaaaaaattgatgcatgcttgctttctctctatatagaactatattttgcagaagtgttaatgatgttttgaaggtgacaatgttatcccacaacatataatttcctctcttaaaagtactatctttgaaatgggctcacataatatgtaaatatatggggataaatgtatagtctcattacaaactataagaattattccatatatgtaaaatatgaactactataattgggtgtaaaaccaaggttgtaaatttaattttaataatttgcctataatatttatcagtccaaagtgatttgaaaagaaaatctattaacatgttttacaatattcttacattatttctatcattatgtatgagacaaatcatgatgtgacagcatgtgacaagtgtagcagatgctgtggatcagcttacacaaaacttattccaactacctcctttgcacatgtttctgaaccgcataactgagaagctaaaattatacttaaaggattcaattgcagctatgattctatgtatgattggggttactctgacaagattattttttatataagacattgttcagaatgtactatgaaggggacaggtgttacactttttgcagttacaaatcggggtggaagtgctgtggttctggtgttagctgtggttctgtagttggcaatgttggcatcagctttctggaaccaggcatctggatcatgggaaaggcagcatttcctaggtgatatggcttggctatgtccccactaaaatctcatctcaaattgtagctcccataattccctcatgttgtgagagggacccagtgggagataattgaatcatgggggcagtttctcccacagtattctcatggtagtgaataagtctcatgagctctgatggttttataaggggaaacccctttcacctggctctcattgccttgtctgccaccatgtgagacatgtattttgcgttttgccatgattgtaaggcctccccagccaggtggacctgtgagcccattaaacttctttcttttgtaaatcgtccagtctcaggtatgtctttgtcagcagtgtgaaaatggccaaatatactatagcagatcagttatgttgtggttttgcatctcattcctggcaggtcaaaacagaatctatttcttccaccctttcaatcatatgtgaactatttatgccacttaataagtcccttcagcttgaagaagctagggtatattgttttttgtaactaatatccctaactgatattgcagacttcacataaaaacatcctgttgaagatgaggaactagaagattctttccccagggacatatgatattaaaaaaaagctacaggtagctggtctttactgtgtacattatcaacctcttacccaaaatactatagtggtattcactgctataactatttacagtatattcagctgttttcttacagtcttagcaaaaccatcttctcatctgttatgacttgcatgtaccccccaaattttgtgtattggaaactaaatgcccaaactcatatgttgatgatatttggaggtggggcctttggaggaggtaatcaagattagataaggtctttagagttagtcccccatgttgagactggtggctttagaagaaaagaaagatgtgagctgacttgggtgctcttgccctctcactatgtgctgccctctcaccatgtatgatacagcaataaaaccctcaccagatgccgatgccatactcttggacttccaagcctccagaaccataagaaatattttttttctttattaattacccagtccacagtattctgttacagcaacagaaaagcaattaagacaccatctcacacctggttttgtctataccttgtgagaacctcacaactgtaattcttctgtataacacatcaattaaaatagaatctagacaaaatgtcagtattaaaacaatcaggaaaacagggctgggttgataataaggccacaatatttgctgcctctgagaatttgggaagggatggatttgaagaagaagttttctgcttgcatatctagttcttattcatatgcacacaagcctaaggggaaaaattcaggctcatcgtccttttgattgcttaaaagcatgtagcagcttccaatttacctttcctaaagaacaagtcaggctgcagaaagatcatggttttgaattcagccatggcttttaatttatttcttttagactttgcttgactggaaagctctggaagctggggttcaaaggcaattgtgtttaaagaaaatacttagttgggaatattctaacagcaactgatgggtttaataattcttgtagatactatataaaattttgaatagctagtatttaggtaaataattgcaaagaaacactcttcttttggaataaattacatggagtcctgttgctgtctacttgcaaataatctcattcacgttttgatgaaactcacaatgtacacattttctgaggaaaatggaaacaggaggcctcctgaagatacaataagatgattatatttattttcaaacctttaaggaaagctcctgcaagttaggctaaaatgtaaattttagtgaggattctattagaagttccaaggcaacagttactttcaaaaatgatagacccactgtgagcaaaagagagaagataaggactctgaccgagctggcattgttgaataaggggccctgatttgctgctcaatagctgactctgcaggtttcaattataggaatagctggaataatactgctctacaatattactggtagaatttgcaaagaattgatatatagagtttaagtatgtgtctctgtatgtgtgtttgtgtgtgtgcatgtgcagcacacagacatgcattatgaaaagggagttattcaagtaaaaagcacctgccgctaccataacaggtatgatctaggctgacccatgatgcttgggtgggtggtgggacattaagaatagaacatttaactacaggcatgcttatattccagttatatataggcccactgcacctctaaattgttgcactagagtctttattttggctggatttaaaggccacttcccaaaatttgtgcagaatctttgtagttacataattaaaaattgaaagaatttaaaaaatgacaactgtagtctcactgactttttaaaataaaattaaaagaccagtataactgtaagcccttgttcagaaaaatgttaattccttacgatctagactcagaatgtggggtttgaatcacaattctatcagtcactagcaatgtgatcctgagaagattacttagtctctctgtcccacagtgcctggtttataaactgggaataatatttattttaaaggattaaatgataagctacagatatgtctttttgcagtgtgactagaaaatagtaaacacgtaataagtgctggttgctgctaccataatgatcagtgtatttctatattgtttatttctggatatcagtacttttgatataagactagacagtgaattcctcaattacaggggctatgtctccagtaaacaagaaaatgcctgtcacacagcactcacattaaaagcttagttgaattgatacaacttgtcagagagactaatactgagggcacgatggccttatcatcagcatatcctcattactttgactagattatttaatttattctcttttactccttcttacttctacttcagttaaaggcaactggggagtatagaaatttgaatatttagctttttggggctatgtccgtagtttattcactacttagggtgacctgtgcacatgctaaatgattaaagaaggcaaattctaggatggtaagtagagaaatgtgcattatagattgaaggcatgtgatgggcaaaagagcctgaggaactgacaatagatggaggaactgacaatagatggaggtcagtaaacaaactgaaaaacaaatgtaagggaaaacatctgataaaattaaaaaataaatatcttatttaaaaatatacatcttcttaaatatatatttatattttaatatatatttaaaattatatatatgttaagtaaaacagaagttactaaaggaacttccacctttgtatgtttgcttgaatattacatctttaaaatagcttttgcaagagatgtttcacaaaagaagttgatcttacaggtattgtagttttctctaaaatgcctaaagattaatactccgcaaagtatttcagtcaatttcaagttggggaatttggatgaccaagacatctctgttctctcaattcctcagaggacatacaccgaagttagttgtgatagtagttattatgcctattaagggtgagatccttccaggttctaacttctattgtcctcaaacacagcactctgaaattctagcattaatgactgttactggctacttacaacaagcaacttcacttggatctaccatccagtttccaagctaccaacattaccttgttgcattgtttttgttgctgttgtttctttttttgcgacagagtctcgctctgtagccagggtggagggcagtggcgtgaccccggctcactgcaatctccgcttccctggttcaagggattctcctgcctcagcctcctgagtagctgggattaaaggcatgagccaccacgcctggccattacattgtttatgtacaagctagatgataaggaccaggcaacacttgtgctatcatattgcatgtgtgcaaggctacacagcctgttgatgcacacaggagagactaagaaaggcagacctggccatggcctacctacttgcttactgaactttgtattccacgaaagaagggagcatgaacatatgtttagcaggaaacttaaagtctagcaaatttcctggcccatagtattgtattctagttgtttgttaaataaatgaatggtctgtatacaatatagcatctctctctctctcaacgaatagcaaaattttttaatagacaagtaacgaagggccttccaatttaatgataataatacatggttggctatctattacagctctttgtgattgttggtttgtgaatctgaaggcactatttctcaaagtgaagtccaggaaccacttgatcaaaggtcatctgagttgctgtttaaaatttcagattcctggggtcacttcctgcatctccacctctgacaacaatattcaggaaactatataatcaacagtctaccaaggtgattttatgtacactactatttcaaaaccttagtgctagctcattctctaggtgaacaaatgaaacaagtataaatatgataaaaagtaagagatctattgatcatatttctacatgaagagattttctatttcagaaattgaagtaatcagctttttaaaaaagcctttttgggaatcaatgtaagtttcataattcagccagctgaccaataaatattaaaaaatgtttaactttcttatatttcatcatttaaaaaaatgagaaattattccatagtctatgtctgtctgtatacattattcagctcccacttataagtgagaacatgcggtattagactttctgtttctgagttatttcacatacgataatggcctacaattgcaataatagacattggagacttagaagaatgggagggtgggaggagggtactggatgagagactgcttaatgggtacaatgtacactatttgggtgatgattacactggacatttggtaatcatcacccaaatcattacccaaatagtgtacgttgtacccataaagcaatctctcagcctctcactactacacaatatatacatatgacaaaacaacacttgtaccccttaaatttacacaaataaaacactacaaaagaaaattgaagaatgatcctatttataatagtgacatgaactaatttgaaaccatgtactcataggagatataagaagaaacaataacatgtcctagaaggccaaaaactgaagacttgaatcaaatgaaagacatatcattatcttgaatgagaagattgaatattacaaacgtgttcatttactcgaatctacaaacttaacattaatctacaaaattaacataattccaatcaaacatttttggagggttttggacctggcatgtttacatgacggaataaatgtgaataatcaccaggtaactctataaaaagaaagttattaagacagagttctcctataatgaatgacaaacataatattgggctacagaacagaagtaggtatacaaatatggaagaatatattacatttattttgaaattaaatttttgataaagttagaattttcagtcagtgaatacttgatactttatttaaaacacagttgtcaactttttactatacgtcaggctatatgaaaatattaactgatttaagtctctttacaatcttacaaagacttacaagttaaaaattttaaatttataattttagatacatgccattatcagcattatataacacatgagaaaacgaagcccagagagtttatgtcacttgctgaaagcaacagcaatagtaagtagtagagccaggttgtctgaatgttctttaataccatgatataagatttaggctggcacttgaagaaaaagaattaaaatcatactagagttcttattttaaaagcagattaaaaatagaattttatttcatttaaatgaacaacataaaaccaggaacgtattagaaaaaaaattggtaagtatttgcatcaattgatgtggtaaaacgtgaaatgtgatatcaagttacataaaggaaaaatattcaaccagaaataccatttcacatagaaatgtttaaaatgtttcatatttcacatagaaatatttaaaatctatacctctaaagtatttatgaaaaaattcaaaatatgataagaaagtacattgtggtatatgtttaaattgtggtaatatgtttgtttttttcctattgtcacagcttaattattgataaggtctttatccacaaaaggggttcaaactgtgcaatacatttttgtcacactaattacaaaggttagtattactatgaaacaaaagtttcaagatcaattaaaaaatatggatgttccaagaaaaattgaagaaatttttaaaaatagtcaatagtttaaaaaaatcagacagagaaggaggtaataaaaagagagaagtactaaagtaagtaacaagagaagaaaaaaaggtagaaagaagaaaataaatattccatgttgtcaagaaggcaggagattctcaaattttagcaatgggattatttgaaagtaatttagaaaatagttaagtatttatgcaaaattattttaaataatattcacagatgtgatatatgtgaaaagaaaatagttgaacataatcaaaaaaattcaaagattataaaatgtattattacaatctatataccacatattatattggccactagggatgatataaaggtaaatttagtgtgacagacaaacaatgaaaatattagaaatggtagaaaggtgactttattgacataaacaaaaatgacaaaatgagaaataaaatgggaaatgttgtatgatctcgattgggtaaaagacaatttatctacatgtgattttcccatacaaatcatttgatccaaatggtatttccaatgacaactgaaaatataaagtgaatttaaggaggtgaataggtataatattttttaaaaaatcgacttttttattttttaaagacaggttctcacttggatgcccaggctggagtgcagtagtgtgatcacagctcactacagcattgacctccctggcgcaggtgattctcccacctcagcctccagagtagctgggactacaggcacatgccaccatgccaagctaaatatatatatacacataaaatttttaaaatttttactttaagttctgggatacatgtgcaaaacgtgcaggtttgttacagaagtatacgtgtgccatggtggtttgctgcacctattgacccgtcctttaagttgcctctcctagctccccaccccccaaaaggccctgatgtgtgttgttcccatccctgtgtccacgtgttctcattgttcaacccccacttatgagtgagaacatgcagtgtttggttttctgttcctgtgttagtttgttgggcatgatatcttcgagcttcatccatgtccctgcaaaggacatgatctcattcttttttatggctgtgtagtattccttggtgtatatgtaccacattttcattagccagtctatcactgatagacatttgggtttgttccatgactttgctattgtaaatagtgctgcaataaacatacatgtgcatttgtctttatagtagaatgatttatattcctttgggtatatacctagtaatgatattgttgggtcaaatggtatttctggttctagatccttgatgaatcaccatactgtcttccacaatggctgaactaatttacattcctagcagcagtgtaaaagtgtgcctatttctctacagtctcacaggcacctattgtttctgactttttaatagtcgctattctgactggcatgagatggtatctcactgtggtcttgatttgcacttctctaatgatccctgatgttgagcattttttcatgtttgttggccatgtagatgtcatcttttgagaagtgtctgttcatatcctttgcccactttttgatggggttgtttttttcttgtaaatttgtttaagctccttgtgacttctgcatgttaagcctttggcagatgggagactgcaaaaattttctcccattaatatgtttttgtagagatggggtttcaccatgtttcccaggctggtctggaattcctgggctcaagtgatccacgcaccttagtctcccaaggtgctgggattacagatgtgagctacctcatccagcaaccaaaattttttagtgttattcgccaatgctgctattaaagaattacatttcagtttacacttacgtcgatctactttaggaatttgtatactgatttgcatttatccaaattggaattttttttaaatactgggacttttctctcacagaagaggtctgagatcttagtctagcataaatgacgaaatggggagtgatagaatagaaaaccaagagaaaagaagttatttaagagattaaaagaaataattatctgaccctttcacatagtcttgggtgctgaattgcaaattctgctgtttctgctgtgacagaataataataattttcttttcaatgatatagagatatttaacaatgtttactatttcatagcactagcaaaacaggaaaaaatgcttgatgtaataaaattatttcacccgattattaatcaaatatagaatgggagaatgtatattaacattatttgtcttttgaaataatattatcacaaatattaacaaactttggatagctttttgatatcttaattcctgataattgctactaattcatttctaagtaacaagtacaatataaattccagatttaaattaaaaatatttgatcattcacaatgctatgactgtattacatttcaatattttacctcgtgttattttctccataaatagagtggttatggttcacaggtacacatgctatttgtttatttatttcattttgtagagagggtcttattattttgcccaggctaaaatgcagtagctattcaaaggtgcaataaagtgcgttacagcttcaaactactggcccgaaaagatctggtttagcattctgagtagctggaattgcaggtgcccagccactgtgcccagccacaattgccactgtgcccagccacagtcagctttttcaagaactgtttaagataacaggttagggaaaatcaggataatattttgaggggaaagaaggtaaaatcaattaagacagggtgcacagagtacttgaatggtacagctgatgtttcatcctttgtactaaatggtgtgtatatgggaattggttatattattttgactgtttgtagtcatattatgtacatatgtgtatacataatttaaaaataaaagacaaaagtaatataagctaaaattatagatattaatattaattttatttaaatataacaaagatttgccagtattcaaatgtctgcaattatccttaaaatgcacagaacctatgtttaggtatagtatcactgttcatccagccttcattcactctaatctactcttatctaaaatttgtagtgtaagtaaaattacattcggtatgacagaagacaaattacagtattagaacattatggaaaattggcataacattgtacaatcacccataactttattatttatcattttgtaacttttttattatattagtcaaaaaatctaactgtacttaatagctaatacatatattatttgattttttaaagactattattaaaataataataatttgggggtgagaaggcctattgaaaaatgaccaacatataaatcataaataagtttgatgcaacaaatatttgtaagtcttataggtaaaaatataaaaatttattctaaacaaagctaaaagacaataatatgcattgggaaatatttgcaacattcacttcaagggttgatgtccgtagagaatttttacaaattaataaacatttaaaaagttgaggagtggcaatagctatgagagataatttacaaacacataaaaaccaatattaaaactgtttaatctgtaagtacatcaataaaaattttattatagtagttattttatctattaaattagaaaaggtcaatacaactgataatctcccaagggaatatatgggagaagcgctttctcatacacttataatatattgttagaatgccattaaataaacatttggcaaaaatctatatcctctgtcaaaacaatttaagttctagatctctagaatccacatatacatatacatatatacatacacacacacacacacattcacacctatatatcaacaactcaaatccaactccaattctttcataagcagtattttgtccaacaaacaaatttatctaaaattcttcttggcttttctccattatagagccagcaattttgtgtagctctacctctaattccttcatttgcatttatttctgctttcaagcccttatatgaggcaaatgggattaatttatttcattatcttaactagattcattgctttaatttgtcaaactctgattgatttgctcaactcaatcttgtgtgttcaagaacttaatgtggatttctgttccacctcatgaaagtcttttccaaaaacttgctaaattcttgactcaagacattccagttagtaatgcatttctctgctcaaatacaatagaagtgtgctctaataaatactcttcaacaatgtgcagttatttctccccaactatcaattccccttaaagcagaattttactaaaaatggctttatccttctgggaataatcagtaaaatggcaattggagggtgaatttaaaatatactaaaagcagatggcagaacatgagtgcagatttttactacaaagcttaggaagaacaaaaggaacctgaatagagaaaatgcagaaaagctctccctgggctattaggatgtagagagcagaagtatgtttaggagcttcaaagagtctgtctctttgcaactgtttatcttaggactttaaggaaataaaaggtgcaagtgaaccactctggattataaaatagaatttcacacagaaaaatcaactcagttaatatgcatgttgcttacatggaaatgttgagaaatttttagcaaatagaaagtggtagatggtaggtatatataaaataattgcagaaaaaatgtgaaatgaagatgtatggtattacttttatatttaaattgttaatatgttgcccataatgctttatttcaaagaatgaaaaaccggaaaaatagttccttcctaacttcccctgcagccttgtcttgtggagcttgtattttacttcatgagaaatgccaaagatatgtcatttaagctgaaacctccagcagaattagccagaatatttgggaaaaagatgtttccagaaaaagagctagtataaatgtccttaagcaagacggagctcatgatgattgaggaacaacaacaacaaaaagattatttcacccaagaaaagtgaattgggagtacagatataaatgatgagatctgaatacgattcatggagcaggtcaaactaggatgtttgggtgtggtctaaatgaatgggtggcatgagttgttttaaggagaggagtgacatgatttgacaagttcttaagagatccctttgattactctggggagaatagaacataaagtagcagaaatgaaagcaaaggggagatagtgggaaataattgcacatttataagcaagagatgatgttggctgggactctgattatagcaacagatgaagaaaaaaggaaatactgagaatagttgattggatttgctgacattctcaacataaatggaaatcagtatttttttctaataaatatgatatgcataaatatttttaaatatttaattcttttaccaccagtggggcatgagtagacttcaggaaacatgccagtacagaaccatataaatgtgatcattggtagagataggctttaataggcatttgaatgtctccctcaacctggaataccacgaaaaaagcttttcgcttcgcatgttgcattattatcataccctatagctttctaccattttcagttacttaatattatgttttgcctcaataaataatagtactttctcttattgtattgtattgtatttgcagcaattattagtgaagttttacgtttcaatattacatctaaaacaaaacaaaattgtcccatactattttccattaaaacacgagatcactatgacaaaaaaagctaaaatgtcatgaaatgacttaaattggatgagagtatatgaaatacattaagaaataatctctgactctgtagtttttttatttgtaggttttactagaacatgaaatcaatatgtgaatcctggctggagtttgcatctaaatgtaataaaataaaatgaagtttaatattatcattgaaccattagtgtacattagtgagctggactatataaaataaactttattatatttagcatttgatttttatttatgtatattataaaatgaatatagtttatattataataaaaataaaagaagtagtatgttaactaattcgtataagatgcctacaaactacatacctgcctaaatttttgacctgtgaaacttcaatggtttgtgttagggcctacatttatatatgtacatgtgtagtgtatatatacatatatatatatatatatatatacacacacacacacacactatatatatttttgtgttatatatacacactatatacacactatatacacactatataggtttgtgttagggcctacatttatataggtacatgtgtagtgtgtgtatatatatatatatatatatacacacacactatatatatatatatacacacactatatatatatatacacacacacactatatatatatatacactatatatatatatacactatatatatatatataaaaatatatatatatatatttagggagggcattgttaatcctttaattttaaaaattttaactttgcagacaaagttgattatacctgtggcagaacaatgcatacagcaataaataaataaataacttttattttctgtggagctcccagaattatgaattattggatagattgagatttgccgaggtcattttcttagagttgcaagagcataggagaaagtcaagggaaataataagcagcacttgatttcctttaccacagaggatgggattctaaaaccaaattatctgactataaatcaagacctatcttttacaggctatgtgattgtggatgttacctcctctatgcttcaatttcctcatctgtaaaatggaattatagcctaccctattttgtagtatagtgaggataaattgagtgaatgtatgtagttcctagaatagagcatgacacatgataagtggtcaataaaatattgtttactactagttatgtgacagtcacttcacacatagtaatgatttaataaaggagcaagaagaatgtagagcacagcttctcaacatcggcactacgacattttgggtcagacaattatttaatgcagagggggccataggatgtttagcagtgtctctggccagtagtgtacctcctcctctccaagttttgacaattgcaaaggcttccagacattgacaaatattccctgaaaagtaaaattgtcccggcttgagaatcacaaatataaagtaaccactcaaagattacattactaattttgattgaatttgaccagcattatgaaatcaacataagcttaagtttctacacttgattttgtcattgtcagttagggcagcagagaactccagttctgaaaattctgagcatgtgctaatagcctataatataatcaaaactttcattttgaattgtatttcttaaaaaatagaaaacgtattaagcagcaacatggaataattaaccacaaaaatatggaacataaatctcatttgcctaatatctcttttgaagtcctgtttcactgtataagtattatgtgttttgtttcacagctagatacagccagttttttctctaagcctaaggttactcctcaaatttatggtggctttttgctcttctaagtttctataaaacttcagcaacctgcagcaggttgaaatttattgatatttagttattcaccaggccatatttacagtcagggattgacttacccaaaccagatgctccccctgccagcagatcactaggagatattgcaataatttccctggttactaaattagcaaaagattctcagggagagagaagggcaagatggcacagtttaatacttactattattcttttattctttaccatcattccttttgaatggattaagaatctgacatacacataacttactaacgaaagggagttaggtgagagggaagacatatttgtctaagaaaagtcttagagaaatattttgaaaagagatagaaagaagagttggattggagtgggtgggtagggaatcacagtaaggagatggatcattcacaatttctttagacatggtgaggcagccacaggaagtctgaacttgttgaaaccctaatccgaagccaaaaaaagtgctcaataaggtcatactttgatcacctctgcctaaagcagttattcacaccctacttttgggagaggaaacatctacaaacctttgttctctttgtttgttagcagagggatgacatgaatttgggaaaaaagtttgagagacagaatgagatttagctcaaacaaatgattgactcatgctgggttgaaaatgtgctctagccgtatgtagaaagctgaaactggatcccttccttacaccttatacaaaaattaattcaagatggattaaagacttaaatgttagacctaaaatcataaaaaccctagaagaaaacctaggcaataccattcaggacataggcatgggcaaggacttcatgtctaaagcaccaaaagcaatggcaacaaaagccaaaattgacaaatgggatctaattaaactacagagcttctgcacagcaaaagaaactaccatcagagtgaacaggcaacctacagaatgggagaaaagtttgcaatctacttatctgacaaagggctaatatccagaatctacgaagaactcaaacaaatttacaagaaaaaaacaaacccatcaaaaagtgggtgaaggatatgaacagacacttctcaaaagaagacatttatgcagtcaacagacacatgaaaaaatgctatcatcactggccatcagagaaatgcaactcaaaaccacaatgagataccttcgcataccagttagaatggcgatcattaaaaagtcaggaaacaacaggtgctggagaggatatggagaaataggaacacttttacactgttggtgggactgtaaactagttcaaccattgtggaagacagtgtggccattcctcagggatctagaactagaaataccatttgacccagctgtcccattactgggtatacacccaaaggattataaaacatgctgctataaagacacatgcacacatatgttcactgtggcattattcacaatagcaaagacttggaaccaacccacatgtccatcaatgatagaatggattaagaaactgtggcatatatacaccatggaatactatgcagccataaaaaatgatgagttcatgtcctttgtagggacatggatgaagctggtaaccatcattctgagcaaactatcacaaggactaaaaaccaaacaccacatgttctcactcataggtgggaattgaacaatgagaacacttggacacaggaaggggaacatcacacactggggcccgtcaagcggtggggggaggggggagggatagcattaggagatatacctaatgtaaatgatgagttaatgggtgaagcacaccaacatggcacatgtatatatatgtaacaaaccggcacgttgtgcacatgtaccctagaacttaaagtataataaaaaaaaaaaaaaaagaaaagaaaatgtgctttttcaacaggtaggttgaaaatgtgcttcagcatttaggataccagatgtaaacatccatgcatagaattagaaaggttcaactttcatggctgctatggtttgaatgctccctccaaaacttatgttgaaatttaatccaaaataggataatattgagaagtggactttttaaagaggggattggatcatgaaagttcctccctcatgagtggattaatccattcgtgagtggattaatgggttatcttgggaaggaaactggtggatatataagaaggggaagatagacctgagctagcatgttagcattctcagccctctcgccatatgataccctgtgctaccttgggactcttctgagagtccccacaagcaagaaggctctcaaaagatatgccccatcgaccttggatttccaagcctccttagctgtagaaaataaattcagttctgtataaattacttagctttggatatactgctataagtaacataaaatggactaagacaatggtcttatcctgaactttgtaaactagaattggctgtttagcttcagcatgtatttttttatagattcaaaataatttcattttgaattgcataatgaaggaatgtcataaggttttcagcatatagaggctctaaatatcagtctggcattgtgataaagcagagagtttaaaccaagtcctatttgtgacacatgacctttctttctggttacagctcagtaacataggaatggatacttaactcaaggataagcatataatacatgaggctttttttcaaaattttgatttagaaaatgaagtattctagtatgttaattatagacatttcaactgagaagtctaatagcattggaccagaatagtcacagcagtccaaagccatggataaacttaagttaaaggcaacaaataataagagccttccacattaatctctatcagagaagatgataaacaggtgaatggggactagaaaccatgcagctttagaactagacataaaacaaacagctatctaatgatttcctatttactatgagcccaagatattcttgtatcctctcagttaagctcctgttttactaaggaaatttaagtaagattctgtctcttgcaagaaaataacatctaagacatcttcgaatttaatgctgctttaattttgtttataccagtggtccccaacctctttggtaccagggattcattttgcggaatataatattttcatggacagggttggggggaaggtttcgggatgaaactgttccaccactcagatcatcaagcattacactctcataaggagcgtgcaacctagatcacttgcatgcacagttcacagtagagctggtgcttctatgataatcaaatgctgccagtgatctgacaggaggcagagcttaggagtaatgctcactcatccacctctcccatcctgctgtgtggcccagttcctaacaggccacggaacggtaccagtttgtggcctgggggttgggacccctgttttacactataacatttgcacacgtctctcatggcctgtctttcagatctgctgtttgtctcgactcaagtctagctacctgaaaattagattttttttttaaattgaatttgaatatcttaaagttgaatacacagtctccacttttacacggcccctactgtcttacatcatacctctctagccctggaagatagcaactttacattcacttttcctgttttagggctattattttatcttcagttatcaaaatctatctacttttaaatactttaacttgaaaatacatagtaagcaattatggattatttaaaatagttttcccatgagtataaaaaaaaaaagaatagcaaaagcaatatttgttgagtatttaaaagtgccaggcactgtgcaacatgctttgcttaagtaaatgtttgacaaaatagaaggtcttttaaaagttccatgttttaacgttaataaccatatcaagataaggttagatattctatcaaattaccatttttgtgaagataggccttttctgctatatagaatctcctcaaacctgagtgttcacattatggattatctagtatactccacagctatcaagtttgtttgtgtttctttctcaagtaagctatcttatttatcttatttctccttatttcttcagacttttcctctcatttctttctctttttctggttttttttttttttttttttttttttgagactgggtttcgctcttgttgcccaggctggagtacaatggcatgatctcggctcactgcaacctccgcctcctgggttcaattgattctcctgcctcagcttcttgcatagctgggattacaggcatgcaccatcacatccggctaactttgtatttttagtagagacggggtttctccttgttggtcacgcttgtattgaactcctgacctcaggtgatccgcccacctcagcctcccaaagtgctgggattacaggcgtgagccaccatgcctggcccctatcctctcatttctaaggaaatgacaaattaagtattttatgcaaatacagtgtagggtcatttaaaatattttttgtaatagatgtctctgtacataaatctatttaattttttcttttacaataaaaaggtattaatgtgttttagtttcaccaaaaatttcagtagaccaactgtgtaaaggtacacatttatatcaatttttttgacctagtaaaaactaaagagggaaagttattcaaatatttcagcataaattccctttccttgaaattgcaatcgtcatgtgtagctacaattgctcagtattactctgtagtatgagtagctacaattcctcagcataagaaacactgaagtagacaattgttaagaaaacaaagtcataacaaaacaacaaaaacaacaaaattaaaaactaggatatagaaacattaactaaatgttactcttgaagccgatataagagaaattattgtactagacactgtggttcatcatccagatcccatcttcatgggaacacatcaatcccacactcataggggatatcagcagctgaccattcacatctgtacctttcacgaaatattgccctaagacaaactaaaatgaactaacctgcccaaagcggtgtctcctttcggagagcatccattgactcatagctggctaatgtagtgatacaaagatgcaactgctttgcctcaatttgggacaactctgaaagatgcccagtaggactggctgaagactcagttcaaagttgtcaaataaagtaaaccatgcccagttgaatttacattgtttagtatgagtatgtcccatgaaatatttaggaattacataaactacacattattcatgatttatctgaaatttaaattcaaccaggcaacttgtaccttcacgtggtaaatctggcagcttttacttagttgcatctgcattgtaggtaagcatgtcggtatgcacagacctctcttccgtgcttccttacaagtgcgtcccagaaaacaagtattcatctcagagccaacgggcattgaggcattcgataatcatactcccaaaggtcaaggataaagaaaatatcccaaaagcagcaagagaacaaacaagcaaacacataacatacaatggagcttcagtatatctggcagcagattttcagtggaaaccttacagccaggagagggtggcatgacacatataaagtgctgaaggaaaaaataaaaaataaaaaacttttaccctacaatagtgtatccagtaaatatatcctttgagcatgaaagagaaataaagaccttcacagataaacaaaagctgaggaacttcatcaataccagacctatcaaagaaaaggttgttagtgagcaagaataaattatctgaggatacaaacctcactggtaatactaagcacacagaaaaacactgaacagtgtagcactgtaatggtgatttataaattactcttgacttaagtagaaagaataaatgataaatcaatccaaaataataactacaataacttttcaaaacatagacagtataataggacatcaagagaaagagcaataagttaaaaagcggggggagattttcaagtgtagaatttttattaggtttctttttggtgtttgtttgtttatgtaaccagtgtaaaattgtcatcagtctgaaataatggtttgtaagataatatttgcaagcattgtggtaacctcaaattgaaaaaattacagcagatacacaaaaaaaggaaaagaaagaaattaaatcctactgccaagaatatcacctccactattgtaagaaaggaagaaggaagtgaagaccacaaaatcatcagaaaacaaacagcaaaatggcaagagtaagtccacacttatcaatgataacttgtaatgtaaatggactaaatgcttcaatcataagacacagaatggctatggctgaatggatttaaaaaaaaagacaaattatctgttggctataagaaacatttctcctataaagacacacatcgactgaaagtaaaggcacggaaaaatatattctatgccaataaaaaccaacgaaagagcaggagtatctatactcatataagacaaaatggatttctcgacaaaaactgtaagaagagaaaaagaaggtaattatataatgataaaagaagccaattcagcaagaggataaaatgattgtaaatatatgtgtacccaatactggaacacccagatataccaagcaaatattattagcgataaagagagatatagaccccaatacaacaatagttggagacttcaacaccctactttctgcattggacagatctaagacagaaaatcaggaaagagacattagacataatctgcactatggacaacaaggatctaatagatatttacagaacatttcattcaatagctgcaaaatacactttttccttcttctcctttttttttttttttttttttttaaagacagagcctggctctctcacccaggctggagtgcaactgtgtgatctcggctcactgcagcctccaccttctgggttcaagtgattctcctgcctcaaccttctgcttagctgggattacaggcatgtgccaccatgcccaactaatttttgtatttttagtagagaccgggtttcaccatgttggtcaggtggtcttgaactcctgaccttaggtgatccgccagcctcagcctaccaaagtgtttggattacaggcgtgagccaccacacccggccaaaatacacatttttctcttcagcacatggaacattctcaaggatagaacatgtgttagatcacaaaacaagtcttaaaacattcaaaaaaattgaaatatcaagcatcttatctaaccacaatggaataaaactagaaatcaataaaaaattaattttggaaatttaaaatatatgctcttgaatgaccatccagtgtttcagtgaaaaagttaagaaggaagttcaaaaagatccaaaacctatgatataacaaaagcagtactgagagaaatttatagcaataagtgcctacatcaaaaaagaagaaaatttcaaaataaataatcaaaagatgcatcttataaacctggaaaagcaagagcaaaccaaacgcaaaattacttgtagaagaaaataaataataaagacaagagcagaaaaaaaaattccaatgaagaaaacaatacaaaagaataatgaaataaaaagtttgtttgttgaaaaaataaacaaaatggacaaacttttaaccagctcacttagcaaaaaggagaagacccaaataaataaaagtggagatgaaaagggagacattacaactcataccacagaaattcaaaggataactactggctactatgaacaactatataccaataaaatggaaaatctagaggaaatggataagttcctagacacatacaagctaccagaatagacgcaagaagaaataaaaaaactgaacaaccaataacaagtaacaagattaaagctgtaataaaaactatcccggtaaagaaaagcccaggacccaatagcttcactgctgaattctaccacacatttaaagaactaataccaattctactcaaactattctgaaaaataaaacaagacagaatacttcaaaactcattctatgaggccagtattatcctgatatcaaaatcagacaaagacataaaaaaaaactataggccaaaatttctgatgaaataaatatcattgcaaaaatcttcaacaaaatactagctaaccaaattcaacaatacattaaaaagattattgaatatgacaagtgagatttatcccaggtatgcaaggaaatctcaacatatgcacatcaatcagtgtgatacagcatatcaacagaatgaagggcaaaaactgtatgataaattccattgatgttgtaaaagtatttgataatgttcaacaacctttcatgataaaatgtctcaacaaactgtgtttagaaggaactaacctcaacacaataaaagctatatataacagacccacagctagtattatactgaatggggaaaacctgaaagcctttcctcttatatctggatcatggcaaggatggccactttcattactgttgtttaacacagtacagaatgtcctaggcagagcaatcagacaagagaaagaaacaaagagcaccccaactggaaagaaataagtcaaattatccttgattgtagatgttataaccttacatttggaaaaacctacagactctatcaaaaatctattagaactgataaacaaattcaggaaagttgcaggatacaaaatcaatataaaaataaaaaattttagaaataaaaaattcaacacatttacaatagccacaaataaaataatatacctaagaattagccaaagaagcaaaagatctctagaatgaaaactacaaaagactgatgaaagaatttaaagcatacaaagaataaaatggaaagatattccatgttcataggttggaagaataaatattattaaaatgtccatagtacccacagcaattcacagattcaatacaatctatatcaaaataccaatgacattactcacaaaaatagaaaaaaattctaaaatgtatgtggaatcataaaacacccagaagaaccaaagctatcaaaaaaagaaacaaacaaacaaaaaaaacctggagaaatcacattacctggcttcaaattacactgcagtgctacaataatcaaagcagcatggtctgggcatacaaacagacacatggactaatgaagcagaatagagaacccagaaacaaatccacacatctatagtgaagttattttcaatgaagatgccaaaaacatacattggggaaaagatagtctctttaaaatatggcgctgggaaaactggatatccatatgcagaagaatgaaacttgacccctatctactgccatataggaaaatcacatcaaagtggattaaagactgaaatctaagacttcaaactatgaaactactacaaaaaattgaagaaactctgcaggacattggtctgagcaaaagttccctgagtaataccctacaagcacagaaaaccaaagcaaaaatggaaacatgaaatcacatcaagttaaaaatcttctgcacagcaaaggaaaaaatcaacaaattgaactgacaatccacagaatgatagaaaatatttgcaaactaaccatctgacaaagtattaataaccagaatatataacaagctcaaacaactatataggaaaattgataacccagttaaaattggcaaatatcaaatagacatttctcaaaagaagacatacaaatagcaaacgggaacatgaggaggtgctaaacatcactgaccaccagagaaatgtaaatcaaaacaacaatgagatatcatcttacaccagttaaaatagttttatccaaaaaacaggcactaatgaatgctggagaggatgtggagaaaagggaatcctcttacactgtgggtgggaatgtaaattagtacaactactatggagagcagtttagaggttcctcagaaaactaaaaatagagccaccacatgacccagaaattcaaattttaggtataaacacaaaagaaagaaaatcagtatatcagatatatctgcactcccttgtttggccagcactgttcacaaaagccaagatttggaggcaaagtgtccatcaataggtaactacatttaaaaaatgtggttcttatatacaatggagtactattcagccataaaaaatgagattctgtcatttgcaacaacatggatggaactagagctcattatgctaagtgaaataagccaggcacagtaagacaagcataacatgttctcacttatttgtgggatctaaaacttaaaacaactgaactcacagagatagagagtagaagccttggaagggtagttgggggtggagggaggtggttaatggatataaaaattagtaagaaagaagcaacaaaacctagtatttggtagctcaacagagggactatagtcaacaataatttaattgtaaatttaaaaataactaaaaaagtgtattggactgtttgtaacacaaaggataaatgcttgaggggatggagactcaatttttcatgaggtgatttttacatattacatgcccgtatcaaagcatctcacataccccataaatatatacacctattatgtacccaaaaatattaaaatttaaaaatatttaaaaatttacttgtaaaacagcctcaggccaatctttcaggagatattgcacaagaaggcattgttattataggagacaacagctccatgtgtgctattgccccaaacacctttcattgggacgagacgtggacgtggaagacagcgatatagatccacatcttgtgtagccctaggctaaaatgtgtttaacaaaaaaatttaaatgttaaaaagtatacatttaacaaaataaaaaacttatagaacaaggatataaagaaagaaaatatttttgtgcaggtgtacaatgtgtgccttaagctaaatgttattacaaaagagtcaacaagttaaataaaagtttattaagtaaagatacagtaagctaagattaattactgaagaaaaaattaataaatttattgtgatgaagtgtacagtgtttataaagtctacagtaatgtacagtaatgtcctaggccttcacatttagtcacttctcattcactgactcacccagagtaacttccattcctgtaagctccattaattgtaagtgccttgcattggtgtaccactgcttactatttatacagtatttttatcataacttttccatgtttagataatcaaatattttccattgtgttatagttggctacaatttccagtacagtaacatgctgtgcagacttgtagcctaggagaaataagctataccatatagcagaggtgtgtagcaggctataacatctaggtttgtgtaagtaagtacagccaatcatgttcacacaatgacaaaatcacctaatgcatttcttagaaactatgcctatcatcaatcaaggcatgactgtatatcagaccactttacttatccaaaatgagccttgtgacaaattcactctctagaacaaaattggatgatgaattagtaaaaagaatcccttaacacaaaaattatgacattttcttacatcttttactttgttagaccaagaatagaagacttttcttctcactagtaactgcaatcaattggtatgacttggagtaccaggtatatcactcttggcaacacatctatttttagtaggacaaaactgatgtgaaaaactgaaaatctcttcaataagagcattgaaactaggaaaggggtttagtgagatttagtatatgtatttatttacttctctgtggtttttaaacttatcttacttcctctttttaaaactctgtcagatttatcactgatttcagaattacaatctttaccatagactacaaatccctgagtagttatgtgatttcctcccttctatcttcccagtccatctcataccatacatttattggtcttctatgtcctagacacaccagccttttaagaggactctttattaatcacaaagatgttgaacagatgattctgacagcctggaattttctctctccacttttctttttcttttacctaggttgaattcattgtttagatctcaactgaaatattccttctttgtggaagcttcaccacatgacccagattatgctaggtctcataacatgctggggccttctcaatattgtgattaaccatgagcatgatgtattttgcctggactatattgcagacaaagggcggactgcaaatgcagctgccgaacaaatatctgtggaaagaaaaaatgattccttattttagacctctactctgtctcattagcattaaatgtcacacaagtcttccaagcttatttatctgattttccaacctgagataaaatagaagcagctaatagatacacagcacagtggaaaggcaatattagaaataggttcagcaggacaggcgcggtggctcacgcctgtaatttcagcactttgggaggctgagaagggcggatcacgagatcaggaaatcgagaccatcctggctaacacggtgaaaccccatttctactaaagacacaaaaaattagccggtcgtggtggcgggcgcctgtagtcccagctactcgggaggctgaggcaggagaatggcgtgaacccgggaagcagagcttgcagggagccgagatcgtgccactgcactccagcctgggcaacagagcgagactccatcttaaaaaaatgaaagaaagaaaagaaaagaaaagaagaggagaggagaggagaggagaggagaggagagagagagagagagagaaaagaaagaaagaaagaaagaaggaaggaaggagggaaggagggaaggagggaaggaaggaaagaaggaaagaaagaaagaaaaagaaagaaagaaaggaaggaagaaaggaaggaaggaagaaggaaagaagttcagcaatggaaaagaaagtaagtcataaaagtgaattagaatgcaaagtcaaagaacacatccacatttaatgggtttttttttgtttgtgtttttgaaaatttaattgaagaaagtaaagttaccctggcttataataaagttagatattataacaaaagataagtcagtgaccttaatatgcaatgtgttttggtttactcatcagataaaatatgttattaatgaacaaaataaaaaaatctaaaaaaggaacatgtagagaaacctagagcttagcagtatagttctctgaaatattaataagttaagaaatatacaccaatgagaaatgacttcagaagtttcactccaagggccattatagctctggaaattcttaaaggattcattaaattttcaagcacagaaatttgttcatttaattgatttttatatatgctttttaccccttttgttagttctgatcatccttaacctacacaccaaatatgctacaattaaaaagagaaagctcataatattttaatccccaaacataaaaactgaatttattaagtacctactaaagtctagaaactttgttacacataccacataattttataactaaatatgtaacatcacaaaatcgagattcaaaatctaacattggtggaaaatgcaaagcatgagtttaataagatattaaccaaaatgcacacctctgtctctgctataactacctcacctctggtttgcactagacttgggttgccacttgatccatagagaaccgttattaaaaacaaaccagagagtaattatgtcaaaactcacaaagccctgatttaaatcatgagaaatctgaataaagcctcccttgtcacacctgtctaattagcacggactctaaattgaggaggggagccctaaaaaggaattttgttgtagctgtaaaaatgtatactctttaccagcagttacaaaaacaaataatcttcatttgaagcaagctctccaatttttcaccaggatagtgaatgagcaaagctacatatatcctgcagagttgctagacacacaaagcaaaggatataggtattacactaattaacaacaatgggacaaatcattaaacatcaagtagaacattcagccaagatgatgaacaaattatctgtaagctaagattaatttgttactgaagaaaaaaattaataaatttagtgtgatgaagtgtacagtgtttataaagtctatagcaatgtacagccatatcctaggctattaaatgttataagtattagtagtagcagtattggtagtattatcctcttttcaaattttaaccacagagcttacatatgtataatgataacatgataaataggaatcagtttttacattggttttgatggttcacactgtctcaactcatggtatcttgttagcaaaagtgcctctattgtccagttaggcctgattttagtctggcatacaattaaatctaatatgtggatgcacataaacagtttgattagatttttggggaagtaggtttctgcagacatgagccactgcttgaatatgcaatatactaatccaatcaatcaccttgatacatttagttgttttatttttataattctctataacaggtttatcagtcaaatttattggttatacttattggtgtaaatgaagaaatactttttttgttccctctcatcactacctttaaatatgctcgttggaatctctttttcccatcacttgagaataactccagccaatctccagctatctagcaatttccaaacacactttcaataaaattgaaagacaataaatctatttttggtaaatttgacttactttcaggttttaaaaaggtctagttgcatgtaaattaaaactacaattttgcaaccaaattaaaacattttccctacctgttcctcacctagctcagaattgatatgtaacaggaagacctgtggttgtttatccagatgtccttcttttgtctatggctccattaggattgtaatggggaaaacaagaatcatagcaggaagaattaaaagaaaagagaaaagctttttttttttttttttttttttaaataatctcatctttatttctattgagaggcaggcacccaaatgcttcttctgtcggggagtgaatttgtaagttctttgtaactctgtgctacctatttgttaacctgagtaatttgttctcctgctcacttcttgctaacacttgccagcggatacctgaagcctcttacatcttctgtggcatgcacttggcctatatatagcatattcattcacctaaagtgggaagaataatctggcatcttttctctttccccatcttgccatcaaaagctgcctcaacgagcatgtagccttcagaattttgaaagccagaagcaggtaacaacttgccatgtttagcttcatcttgaaactcttgaggacacctatcaaactttcccaaaactgtctcatcatgtatggttccattgcaggatgggtgcaatgctgagtgccagcaggggaggaatatcccattctttccttcttgaaattgcccccagtctttttgagctctcttcctatttggaaggagaactaaagcaagtttagttctcctcacaaaagagaaaataattgaaagcactctcacttaggcagctaattcactgtctatatgataattcttagaatgcctagtcctctctttacataagagcacaggtaattgaggtcaatgaaggttgtagagtcacagaacttgtctggctactttttattaaatcctgcaaagacttaactattcttctgtaatttagggataccggtcatttaatagggaataaacaaaaatctgagacataaggaaattctgtatccattctatatatgtataaattatatatagaaaaatagtttagaagagttaatatcaatttgaaaataggaattttaaagctgtgaataatacatagcataaatatgtataaggattcagcaaaatgttagttgacatgtggctaaataaacttaaagtttaagaaagataagaaaagaaaccaaatatgcataaatctggggacaaaatttgatattgctgctaataaaaaggggaggggcatcatattgggaagcttcattaataaaagtaacaaattatgagaacaaatagtcttattatagtttatctggtgaagcattttaatgaggcgtagttgtctgttccattacggaaagagttttcttatgtgtgctctggtagattttcatgtggccacactgaaagatactcccaaatgtctgactaataattctatttataggcaactgttctgaaggtttaaagtaaggaggatgaagttcatttggaagcagtggggaaaaaaatggtaatgctgggctttgaattttatggatgctgtagctgttctttatttttcaataaataaatgttttaaatgccatgttttttagctattgcagttaaactgccctcatctttttgcccagcaaaaaacccattaagttattcactgagattgactctagattttttataaaattaataactttgctaccagtttctcaaaaatgagtagaaacgacttttcaatgcaaatgccagtttttgctacagtgaaattattctgtctgtagtgactatttgaacatttatgggcaataggacattgagagatttagtatatgaactacgaatagatttatccttagattatctaatacatgttttccaccttgcaacataaaacctgatctctttttaaagtcctggttgttctgaaaaatgaaatgaaattatagtaaatggaattttgactggggggaaaaaaacttcacatgatttaagagaatggatgctggcaattgactatctactgtttattcaaagcttatagattagcaaccagatgtggcagaaagttggctgtttttcattcacaacaaaaacgatgctgtgcttaatgaacggaggtttgttatcccagtaataagtaaaaggaacatgaaagcccttgtgtttaatgcttatgcaaataagctatttgcaggtggcttttgggcagaaggtaaaatagtttcaaaactgggtcaagttttttaatcctcaaaaattgccagctagaggaaaacctcctaaaatctttattatgctatttgccaagtaaatgaaatgacatcatttatcatttaataaattacatatgaaaattcttttccttatgatttcatcaatcaacaaataaattctagaggattctagatacatttatttggcatattttttaatgcggtatcaaattttgtggatattcttttagagaatcaatttcttaaaatggcattgaacatttaatttaaaatgcccttcttgaaccatacatgtttattagaaaattattttatataggttgtccattaaaaaacaattttctatgtatgtaaacatttatgataactgctcaatattttggtccatatttatttatctacctatttattacacaatacaaatattacactttgtaaaattaaaggcctagtctaatattactctatgtcggaagtaaaataattcagagaagtctatattaaaagacaagataaaacacaaaatgatgagaatcacaaaaccattgccaaattttcagctatgacatttattctccatgtggccttaggtatcttactctcttattttaacctttgatgactataaaaataatttgttactaagaagccctctcgctttagtagctgtgactataaaattaagaacataattcacaaaaagtgtttgagtcttcctgaaaacattttaaaatatcaattaatcattgcacaatacacaatcgcctgatcatttgctaaaagagggttgcattctcatctctgttcactctgtcctttctgagactcatataggtgtgagagctagaaaaaatattaatgtgtagcaattcagattttctcattgatgaatcacttcagcagtgcacagaatactttgtaattttaaaaaggtgtttttattaatatacttctactattctaccccaatcaacagcaaatttacctaaatcatgagactgctggaactgctaagttttataaataaaagacttaagaactactattaaaccctgtgaatcctttatctacaatgagaatgtccatgagtcagctcttctgaccctctggccagtgttctggagttactgatctgcaactttctaattgaactctagcttggtatgtgagagcagctgtgggttaaccagcggggcgacatttaagtcttgacattgccattaatgattcaccacctgttgcaagttcaataagttattcacacaccaaattgtggccacagaattcattgagataaactaagttagaaggattgggtgtcaataaatgtttgctaaatcagaattgttaatgatagaaatccgtagcttaacaaagttgagaaatcttgtcttcttaacgtgtatttattgacttcccaggatatgtcttagtgaggaaacatagcttctggcatttattattagagggataaggaataataaaccacagtgattgagagacagggaaaggccgggggacctagagacacagtaacagaagaagtttaattggctaatgaaataaacttgagataagagagcagagaggaggttcaagagatgaaaccacatattcctctctatctgctcccaccatcaagggaattaataacatattttataatgaatccctgataaatattagtgtataattgaaaatctattaaaatgactatttctcagggtgcagaaaaatattaaaacaagtaaagttgccataagatggaatattatattttcctgcatgtctgcttcaaggctgaatcctaatggtcatgtatgtaggtaaattattcttcctacagcaacttctgggaggtggtatgtggtggggtataaaaggccaggggtgtagtgagggtaaagtgtaagtactttgatcttgagccttgactatattggacttgggatctcagaaatcttggggataaaccgtggattaaatccataaattcataaagtgttggttatacaacgggtagaaactacgtgccacttttggagggacagtctcctttttttttaaaaaaaaaaaaggccttaaaggctatatatatatatatatatatatatatatatatatatatatatatacagtcttttttattataataaatactattttgttttttttaaatgaaacaatctgcacatatacaactccactctgaaggcaattatttacataattatgcataaattcctatagttatgttagtagttgcctttcttcagagtggagtcatatatgtgcagattgtttcattttaagaaaagaaatatttatttatttgattaactgaaattatgcttaaaaatgattaaaatgcacagatctgtcttcatgaagtttaaatgtcttataagaaattaaagtaataaagactacaacatttattatttaactgtaactgtagtgggtagtaaaagagaaagcccagtgtgttggctttcagtagtaaaaaacccaacttgtggttaggaaacgccattgtttattgtatctaaattaatcaagttgtatcctgtaacaggtttcctgttatccactcgtcttccaacttctgaagtatgctttaaatgacaagggagaaacccagacactacattttctaggatctcagcacaacagagctccaggtgaaattatgctaaatagtggcatgagcgtgagatgtgggtggcataaagaagaggtttagagtgtttttctggtgacctcctgtttaagtttgacaagcatctgaaatcactgctagcaactttcccataattattgtgtttccagcctttatgaaaatagcagcaattttttttcctttctttgcctatgtacaccatctaatcatgagataagtctccttcttagtccctatattaaatatctttttacatgaaatacatagattgggatctttttctgacctgttcctgtctgacatattcttcaactctaagatgagttcatactcatcttcggaagcccctgggaaatgggaagttttttttcatattagatgttggtagatatagaggcccatcctttaataaacatctatgtgccagaaaatgtactaggcacttagatacattattcatgtaactctacacaaatgtatcaacaacacaaaaaaaaatctgtataaaataataattattatatcccttatatggaaacagatccagagaggaagatacactagcacctgtaaatagaggatccaagaattaaacatccatctgtcggactgactacaagctctttctttttcataaaatgctaatttctctcctgcttctaatatttgtatcaaaatttgtcatctattgttattgggtttataggtgggtagtgactccttggcttctattttgttctagtggattactgtcttctttattttcattctagtgtttattgagagtcctaattaatcaacctggctgctctgacttccatcagctcaccattgtctcttttcccagctcataatttctgtaacagagctctaagctatgctaaacttctgctatatgctgtcagcctctctaaatccaagtgctcttatctgccaagtttacatacacatgtttaaaatcttcttattgaatctacatacaaagtcttcatgtcttcctccttgaaataatagcattgtgagagaaaaaaaatcttcattctttttaaaactaattcagaatgtctaggtaacacaagaacactctgcaacaaacaagaggtaagggaatatttacctggtatttctgtgcctcattatcattctcactcattataaaattggtatctgaaaaaaatcttgctgtaaaaacaaaaagtaatgtatagagagtataaacaaagagtttgcttcacatcataaccattatgcatcccattgccaaagggaagatagtacactacatgattccggggaggagcatcattcacatagactatagtgtgcatggcacatgcaagagaccccacagtactacccgctttgttctctttgtagacacactcacggatgattcatactccctgacctggagtagccaaataaagagttgcatcagtttattatcattctttccagaccactttctaggtattcccattatacattccttcaaatagaaagattttattctgtaaattgcatcgcactgtacacatttttttctgaaatctgaataatttcatacagtttcaactgtgagagtacctgacagactgacctaactctaagctaaaacactcataaactagcacagaagcttgtcatatcattacacatttatccattgctctaaattacttatagtttttcctgaaacatctattaatattgcagttatttgagatgactgtgagcttactatttgccagtgatgacatgagcaccttggtttagtctagtgcctggcatttaataggaccattctatttattttcctaaactctggcagcaagattagctctaagcatatttttttatcacaacaatcgtccatctttaactacatgtgaggaaagcactttcttatattgcattacacatttttatatggccacagaaatccttacttaatctgacaaaattaagataaatttctttctcctaagttcaaggaaagaatcattctctactgtttccaaggagatgattctccttttctcaattgccaattgtctactgcttgtcctgggttccatcttttcatatgtcatgaggattctcaccccagtgttctgctcctctgagtcaaagcccttgacttttcacttctcaattgttttgtttgtaatttttttgcttttatttttttctccataaatgctatgaaagtgtatgtaaaaatttacccatcttttattttatatttgttatcacattttattcacataccaaactatacaggaaatgaatataagcacatctttcttagtaggaggtagaagtaaaattttgtttagaataaaaacagaaaaaaagagaatccaattccatatcaccagtttgctcctgaatgtgcaataagtttccacttatgagcttgctactgtacacaacgcaagagcttttaaaaaattgtctacatgatagtggttaagagcgtactttaggctaggttactttaaaaaaatatgtcatcattacttctgccatcaaaagctaattcaatgtatcataattgttaaagttgagtagggttaaggattcttctcattctatggtttccttataaacacagtttctaataaatgtctatttttttctgtgaaattaaaccactagatattgctgaatgtctgtatatttcttacatttctagaatctcattcttaatttttttcttatatttttccttcaccaaagtcttaaaacctatgcacctggtgtctattatttaaattctgtgatgtattttatttgactttatttgtgtttttagtcttttcacagaaattagtttattgtgatcttcttttccaaaaggacttaattcatatctcttttccatacctatcttcattagcaggttgcatttcagtttcttcagtgcttttttagataatatattttactacatctttcttcacaacactgtatatgctctgatgatcaggtctctcattttttttaagttcttgtcccctttgggacccatgacaaagtaaagggcagattttttctcacctggcttaaaagtaaaaagccttcatatgtttctcctctgattcttcttaggcccagcatttccaaaaacaaactagtacacaaaacattagagttgcaatgatacttcaaaaggttcaaatactaatttttgtctgctttctctctatagttttcttgtagagaaattttctgttatgaaggttgaactatttgctatatgttaatattttccaaataaagtttccaaactgatatttaaatacattctctcatattcaaacatattctgaactactttctgttgtgtctctagatcaatatttataaaactagacagttcatataatttttttcctttgctaactttcaagatcatatcaaaaagtactactgttgattcggttttttgtgtttcattatttgaaactgtattgacctttttcctcttatttctttatcatttcctgttatttcatctttgtgagtcttcccattaatgtctttttctttttgaattatttattttttaattgacaaataaactgtatatatttaagatgtaccacatgatgtcttaaagtatacatacattgtggaatggctaaatcaagctctttaatgtatgcatatttaatatatgcattaccttgtaattgggccccttgagattttagtatctcagcatttttagtgcctgagatttaaaaaagtcggattaggctcttgcttgcttgcacaaaagccaacatcccttgttctcacaatacaattgcaaactgctgatgtactgtttctttgtcaagcaggagaagataacttcaaggtaacaaaaaacattcgcagaaggaaagaatgcctataagattgttgcaactaactgttgagacccagaagtctggttgctcaggatgttatcagagattaaagaaacacaaacttccccattggttccctaaaactccccctctcttactctctggctgcaaacaaacctctctgctttctcttattgttaagacatatctgacagatcttgccccgttctcgctttggccaagtggaataaacttttatctatctctaagcgttggtgtgtcagtgtttggtttcgactgagcatctggtacatgagcctgaatttgggtctctacaacatcttcacctagttactatttttgtgtgtgtgtggtgagaatacttgaaatctactccattggcaattttcaaatataaatgtattgttattcactgtagtcaccatgatgtgcaatcaattttttgaacttattcctcctggctaactggaattttgtgtcttttgaccaacatctccgcaatttcccccatgccctagcttctgatgatgaccaattaactctctgtttctatgagttttacttatttaaactctacatataagtgagattatgtcatgtttgtttttaagtgcctggcttatttcacttgacataaagtctcccaggttcatacgtgttgttgcacatgacaggatttctttcctttttaaggcccattaaccttttgtagatctgttactgaggtaatcaaagcttactggacaattatgttatttgagtaaattgaaacataacagcttataaagggtcaaatggtagtaatagcctaagaaataggtttggaatattatttcttagcataaaagacaaagataatattggtcagagtcttctaggcttgaattcttggctacttagattttatcaagtaaattgtaaaaggataaccaatcaatatttcacatgtatttctgtatgaattttgatttgacaagaaagactgtgaaaacaaaaccactattatctgtgaactacctaatgtggaaataaatatccttaaataaaaccttgagaaagtatattactcaattttttttctacagatatcccatatgttataatatttaactgaaaacaaaatctttcttcttaagaaaagattttattcagttttagaacgttaaagtttctccactctaatatatacagaacttctctaacctttaaaaatactgctttgcttattactcatgataattgggccacatacataattaaaacacaccatttattattttgccatgtgaaagtggcatctggttccccaacttgacttcaaactgtaattttaaacaaataataaagtgttttgaaacattaatgtcattaattgtcttatctattgtctatgttcatcaggagctgtgacatgcccaaaggaaggtaatcagaggaaggaagagaagaagctaagttctagagaatccattaatcattccttagatgactgaccattttattattttcccaagtaagctgaggctgacaatatcatgaatcatttacatatatcagtattcaaatgttccatttttaaattgggagggggtatgttttagaatagaataatgaaattccctccatctcctcctaatgtacatcattaagaagaatctaatggaaacataaggttctaaggctcttgttggaaaccataatcagaactggaggaattctcttatggaaaacattaaaaaaaggaaattctagcaatagaattcattgttaaagctgtaagttacaacaatattgtctctgcatgctgactgtaatcctctataatcttcaaaggcaaacaggaacagtaataatcttttcatgtactcttaacttccttctctgaaaggctagaaaatgtcttacatgtagcactcatagtgtcatttaatcaaacccagtttctatttttcttcaacttctagatgaatggatgcttagtctttcgggcacaatgtgaatttcttaagggtctgtagactacatctcctatttttacttctcaaagtttctctcaaattgtgataaaaagtttcactctattggtactgttaactgccaaccactttgaaggcctcctcctccacttttttctttttccccatatctaggcaagcagtaagaaaactcagagtctctattccttggctacggcagggaagttcaaaccatttaaatcctgaactattggggctgagggtaagggactcacttgggcccaacccttaaccccattaaataccagaactccactgactcttccttaggtttcacttcccactgaacctgagccctttttgttgtggattattttgccctttagtaggtaataataccatgtaagtaataaatttgtttcatttcctttcagtcttgatatccataaattactaggggcaggggtggtgtagagttgcctagtattcaccaaataaagtaaaaacaacacacacactgagagaaaaatctagagaaacattcccacattgccacacacagttttcttgcttgcttctggtaaatataaccttctctatccatgagttcaattaacaactttggataggaaatattcataaggaaaaatggatggctgcatgaaaggagagtgttctacctgactttattcactaatcaggatatgcctaaaaactgggtggcaaaaactgaactgtaggttttgagaaagattctaataacaagaaaaatgtacaaacatttttattgttgtttatccctaagcaagacagcataacaactatttatacaacatttacattgcattaagtattacaagtaatctaaaatggatttaaaatatatgagagaatataagtaggttatatgcaaatactaggccattttattaaaggacttgagcatctggagattttggtatctgttgggggatgggaggtagggcggcaggtcctggaatccatcccccatggatactgagagacaaacatacatagaagctacaaaagcaaattacttatttcgcctcttgctgttgacttaaggaaaactatgcactgtatcatcagtatagagagttcttgaaaagcctagatcctcccaaagtttgaataggtgttgcaaatagcgagatgtggtgatagctcaaatagagaacctctcgggaaaaccatttccacatttagaagcaagtttgaagtggcagatgactattccttttttataaatatatatatatatatatatatatatattatactttaagttctagggtacatgtgcacaacatgcaggtttgttacatatgcatacatgtgccatgttggtgtgctgcacccattaactcgtcatttacattactttttctactgaaaatattttcttggcttcctgtcaagtaatgtgagttgcaaaaggcattgaagattggaccaactaatgaaatggaatcaggacatggtttcataaaataagagtgtttttttgtaattatttatagtttcttcctttttttatttttttaacttatttatattccaaatacggtttgtcatttagctcaactttttattttgccccacatatcttcttacggcttcttggtttaataggataataaaatttctaaagcaggctggtctatggcttccttaaattaaccctgcctcttctcttacaaaagttactaaaggcaaatataaataatcatgaccaacatataaagatatgaatgagatttacagagaataactttactcagttatatagcgttacccacaaagggaatttactagcttcaattgaaaaaaaaatcccatgacacctatgatatttacttctgtcatctccacattcaaaagaaaacaaacagattacccacatatttaatcactttttattttacaaatgctctgtaaacaaaatgcttctcagacctattcaatacaattaaaatataacatagctttgccaaaaggtgtattccaaagttatcagttagatttattaactgataaagattagcaatttaatgtgaatgttttctttagtgaatatacagaattctctcaaagttaaattattaaaaacatacctaaattcacctaactcaaaaatgtagtattcttatactcaatatctgcacattctcacatatacaaaaatataatctaaatgttatttttaacaatataaaatttgtttctctctttgttattgccaagattgcactgactgttgaaatataaaagaaaaacagcattaaatcaggtgtgataaaatcacctttttctgtttatcttcactactggcatttattggcacttggaaactatttataaactcatattcttattgctaacatcaattattatgcaaatacttgaaatttttactgacttcataaataatgcatgaaagtctatagacttcaactagtgagcattatcttttgtggtttataaatacagaatacagaataaggtatagtttggatgagtctgaacaacagatgtttctgctttatgaattctggtcaaatcatttggaaagagttttgtttatacaataagcatctgcgttttggaaagttaaactaaaaattattttgtcattttctctaatagcttgggacctacataaatctgttaagttgaccttaaatagaactgaaggtgatagtagaggtatttaaaacaagtttggatagtttttacacatgtaaatctataacatacatttaccaaaatctaatatttaagaattaatggaaattatacagttattccaactctaaagttttatgacacaaatatattacttagatagtatcttcacattaattttgtttaaaaatctccattatgctttagaggggatttcagtgagaatatatataccccatcatattttatcaagctgaaaactgattatgcaactttttgtaagtacagagcaagtttaatccatttaactcatgccagacttcaggcatttaagaataactatcaagtattcctttaagaatttttctttacaggctagtcatccttacttccttcaagtaattgttaatttgcttgatgccaggagctctaaattatgtagaattcattttactaatttccattataatatatatttcgtatatatcatttgcttcctcaaaacccacagttcagtttttgccacccagttctgaggcatattctgattagtgaagaaaagcaggtagaaaactcttttactaaaaataaccaaaacatagttgggaggaggtgcttagggcatacatttttgaccttgtttacctcttagccaatactaagtgctttcacatataatcctataaaatgcttctcctccatgctacacttgaataatcaaaattttgaggttatatatatataatttcacaattgcctttttctttctctattcaacaaattctaccccttagacactggctttctctgtttcttctgtggtagttgatagaattttacctatatttatgctaataaatcaattatccagctatattttgcacaggggtcctgctaatcttcttgaattcttccaattttagtatacgtgctgccaaagcaagtgccagctatttttgaagaactgatatgtactcctaagaacacaagataaagagaatcctaggactaaagttggtaagccagttttttttttccatttcctattctttctttttacttctcgtcttccattctagagctgattcacaggaatccttcaaacacttcttggataggtctttctggagtcccttcaaaagttcctgtttatagatgcacataagatatgagagggtctgaattcttcatgagtccatctcttttgttggaactcaagaaaagagactagactggagagtagaactagattttttgagtcatgtgtaaataatgactacaccgcatgtacacatttagatgctgtccccagttcaagagttctgtccactgtcaaaattcatgtccacctggaacctcagaatgtgagcttgtttgtaaatcagtttttgcagatgtaactagttaagatgaggtcgtactggagtagagtaggccctaaatccaatcactagtgtctctataaggaacacttttacactgttggtgcgactgtaaactagttcaagggttgtggaggtcagtgtggcgattcttcagggatctagaactagaaataccatttgacccagccatcccattactgggtatatacccaaaggattacaaaacatgctgctataaagacacatgcacatgtatgtttatcacggcactattcacaatagcaaagacttggaaccaacccaaatgtccaacaatgatagactggatgaagaaaatgtggcacatatacaccatggaatactatgcagccataaaaatgatgaattcatatcctttgtagggacatggatgaagctggaaaccatcatcctcagcaaactatcgcaaggacaaaaaaccaaacaccgcatgttctcactcataggtgggaattgaacaatgagaacacatggacacaggaaggggaacatcacacaccagggcctgttgtggggttaggggagggggtagggatagcattaggagatatacctaatgttaaatgacgagttaatgggtgcagcacaccaacatggcacatgtatacatatgtaacaaacctgtacgttgtgcacatgtaccctaaaacttaaagtataattttaaaaaaaagaaaaaaaaaagaaagtgaaattcagacacggagacagagaagcacacaaagaagaaggtcatgcaaagaaggaggcagagataggaagaaagcagctacaaaccaaccagaaccaaggatttctgagagccctcagaatactggaagaggcaagggaagttccttccctagagccctcagaggaagtacagccctcagaggaagcaccttctaacctccagaactatgaaagaatacatttctgttatttttaagccaccatgtttgaggtaatttgttacggcagctctagaaaacaaatatacacaggactcttctttccaataggtctgaaatataaatgtatatttatatacatctccttgaatatataaatataatagagattaaatataacagatttatagatttataaacatataacagatttatatatttataaatataaaacagatttatataattttgtaaacacaaaatagatttatatagttttataaatgtaaatatatgcatatatatttaatttttaattactaaaattttttctataggctctcaataaggcaaatacacaatgaccaaacagaataataattgcttttcatttatagattataaatgcttttaattgatagattataaagaatttcatttatagattataaagaattactgtgggcaattaaatcaaagccttttcaaaaatggtgcaaaactaaatctatagtattcaactgatgtttaataaatattaaacattattaatatttattgttaattttaattaatttttaattaataattaaaattattaatatttaataaatattaataagcatcttattcaactgatgtttaataaatatttctgtggattattcctctgaaataatattttaagaatacacatgcatagacataaatgtacatacatggttcaatgtggtgttttattccttgcctataattacacgggtaaaaagaatgcatatttatgctgaaatgaaaccattttgctttctaaaaagaaacccagacacacatttctaagtgcaatgacagcaaatactgatacattcacatacattcttttgtcttttgaccttttcaagcaaaatcgtgcaagtatatctaggttacatctgattagctttcacatgttttagcaggttttgagaaattttgttttataactttgataaggtttggctgtgtccccacccatatatcatcttgaattgtaattcccataatccccatgtgttgtgggagggatccagtgcgaggtaatttaatcatgggggcgattactctcatgctgttcttgtgatagtgaatttgttctcacaagatatcatggttttataaggggtttttccctttttgctcagcacttctccttcctgctgccatgtgaagaagaatgtgtttacttccccttccaatatgattgtatgtttcctgaggcctctccagccctgtggaactgtgacttaattatacctcttttctttataaattaccaagtctcgggtatttcttcatagcagcatgagaatgactaatacagaaaactggtagtgcagagagtggggcgctgctgtaaagatacccaaaaatgtgcaaacaacattggaactgggtaacaggcagaggctggaaaagtttggagggcttagaagaagacaggaagatttgggaaagtttagaacttcctagagatgtgttgaacggttttgaccaaaatgcttaaagtaatatggacaactaagtcaatgttgaggtcttgatggagataaggaatttgttaggagttggagtataggtcactcttgctatgcagggagactggcagcattttgccccgcagaactttgaacttgagagagatgatttagggtatctggcagaaaaaattctaagtgctaaagcaatcaagaggaagcagagaataaaaggtttgaaaatttgcaacctgatgatgtgagagaaaagaaaatctcattttctggggagaaattcaagccaatagggaaaatgtctcgaggacatgtcagagaacttcacaatagcccctcccatcacaggcctgaagccctaagagggaaaaatggttttgtgcccctcttccgacaacccatgcagcctcaggacatggtgctctgcatcccagctgcttcagctccagccatggctaaaacgggtcagtgtacagctcaggctgttcttcaatgggtacaagccccaagccttggcagcttacacatggtattgggcctgcaggtacacagaagtcaagaatagagctttgtgaacctctgtctagatttcagaggatgtatggaaatgcctggatacccaggcacaagtttgctgtgggagcagagccttcatggagagcctctcctggggaaatgtggaaaggaaatgtggggttggagccccacacagcactgtctagtggaatagtgagaagagggccaccatcatccagaccccacaatggtagatccatccacagcttgcactgtgcacctggaaaggccacagacactgaatgtcagcctgtgaaagcagctgaagggggggcataccctgcaaagccacaggagcagagctgcccaaggctgtgggagctcacctcttggaaaggcataacttggatgtgagacatggagtcaaaggatatcattttggaactttaaagtttaatgactgtcctattggattctgggcttgaatggggcctgaagcccctttgtgttggccaattacctctatgtggaatggatgtatttaaccaatgactgtatccccattgtatctatgatgtaactaactcacttttgatttcacacgtttgtaggcagaagaaacttgccttgtctcagatgagactttggacttgaactttcgagtacatgctggaatgagttaaaactttggggaactgttggaagagcatgattgtgttttgaaatgtgagtacgtgagatttgggagggactaggggtagaatgatatggtttggctgtgtccccacccaaatctcatcttgaattgcagttcccataatcttcacatgtcatgggagggacacagtgggaggttatttaatcgtggggttggttaccctcgtgttgttcttatgacagtgagttctcaccagatataatggtttataaggggtgtttctcccttagctcagcacttctgcttcctgctgccatgtgaaggacatgtttacttccccttctgacatgattgtaagcttcctgaggcctccccagccctatggaactgtgagtttattgaacctcttatctttataaactacccagtcacaggtgtttcttcatagtggtgtgagaatgaactaatacaatctttttcagcttttgtttcttagggatgcaattcaagttaaggtaagagagtagtgtagtataaatcagccttgctaagacttctataaatcatgaattcagcagctaattcaaagcacaattttgtatatggtacaaaagtatctattgtagatgactaatttcaactctaactatcaaagtgacaaaaaaacgagctatcaacatcagccctcctcaaaaatgtatgcactattttactaatagtaacaactaaacaatgagcaatattaggaagattaaaacccataatgtaatgtactgtttgacagccaaagactttaacaatgtcctattctttctagtacctctggacgctttattcttctgctaacgtcagccctcctaatctttcacattacattcctatattgcaccatttcagaattttctgcctcacagttggaatgttaccagatactcctcagtgtatggaccacctgctattgctctcagctcatgtttggagaaaactggtttatgtaaaattttattttttttcttctggtaaatgaaagctaatttgcaatatgtttccatgggaaaattctaggcataaaaattatataaccacatctaaaattgctaaacaatattttttaaaatacttaaaatttaatgataaatcatagtcataagcccataaaataaagtaatatcaaaatgaaaattaggaacacaaaactatgtgctacagggaaaaatataatccaaaagttctcaaacagtctacaatatctataaaatctgtgtattgagtttctactctgcattcagcactgttttatgcccaaacataatacaatattcctgtttcaagtggagaagtttgggctgtatatgggatgttgtttccatacatcagtggccactgaataacaataaaactcacattctattctcatgaaggcatgcttgtaatggctactgccaaatgagactctattttacaatagggtgtgtatttcttatgtatgttttatgtatctcccttatttaaaggatttctttccatatgcttttcttttattaaagttgaagattctgttctactttacttttagacaactaacttttgttgtttattccatagagtctctatttgtttctcaccaatcaatgttgggcatgaagccaggcccaacagaagcccttagtccatggagaattacttttattcacactaccgtaagaattagtatcttaaaaattttccaatatgtgaatgtagtgcttagaaaactttaatcattctacattgcctttggcattacaattaaatatctggcttaatatataaagcctttcacaatttaacttaatggcagttatcttctctccatacaattcactcaacctcaaaacttaaaactacataaccattcgtggttctttgctttttttttctgtttgccaggctgtatctaagttatatcagattactcaagtgtcatctcttttatacaccctttgtgatgcttgcagggtgaatctttcctatggctaatagtttatataaacatctatcatagcttatgtttttagttatatatttacttgcagaacttgttctttgattacaggcattcaccatacatgcctccctctgacttccttcaaaacatacttcagtgactgaactcaacagtcattgtagcttagtagtaaaaacaacgtattcaggggccaagattcttgcctttggatcccagggtcacgtactagctgtctgaccttgagcaagttacttacttaaactttcagtatcataagtttcattactagtgtgctcatactagtgtacagcaggttcttaaataatgttgtttcattcaacatccttccattgtaacattgatgagaaaaaacaaattcctggtgggatccactgcatgtatacagtttgcaccttctccccatgtctgcgtgggttttctctgggtactctggcttcctttcctatctcaaaaatatgtcgtgttcattggtgtatctacatggtgctaaaatgacagagagagagaaacagagaaagagagagagagagtgtgtctgtgtgagtgtgcccttgatagaacagtgtcatgtacaaagtttgttcccaccttgtaccctgagttgcccagaaaggctttggacacctgcgacaggaacaagaaggcgaataattatcttacttgtttttattaatctttcttaaaagtacatatagctcatgtttatttcaatatttaatattataaatatttttatctttatttagaagcttgatgttttcatgaaaagaattatgtcataggaacttgactcttgtttatatcaattaccctatgatcaagtttgttcctatataagttgttttgcatgaagtcgtagttgtcaagaacctatggaggatgttaagtgaggatttgcagtataaaattcttaggttatttggagaaaaatgacttaatataattagtcccataatgtaaagattttagagattgacgtgaagtcagtgttttatgaggatattagaaaaagacaggtgagagacaggatagaaataagaaaaataaatattgaaaacatcgtttccaagaaagaataatttctatatgtaatcataaaattgcagtaatggatggatttactaaaaaatctattccagtgctcagatgaaggaactgaaggcctgtgaagtcacacaagtttaaagcagatataggaataaactcctatttcactggtctcttccagagaggtttttgttttatccttgactaaagtctgcaacgtgttttccttatgtcaaatcttgctcttaatgtttttaggcattctgtgaccttttgttgactacttgacttagctctttctatttgccattactttaaatgtatattataagcctgcattgaagtttttcaaaataaaaacatacccaagctgttcttttccacagatgatttggggaataaaaaaggagaaataatacagtctaatttcactattgaaacagagatcagttgaactaaaacagaagaataaatggggtataaagcagtccactaagatattcataatttcatactgaactctttaggaattgtgatttcttaactagattcatttatttatttgataaagttttactgaataccggctatgtgcctgactcatctattgattagcaagattaacatggttcctacactcacaatgctcacattttgctgtagaattcataataataaaaatcatcataatcataaaacttgaaatagggacaactgatagccatggaagtacttttctgaaaggagtaatattaccatatttcaggttttaaaacgtcatttcagaaaaaatatttggagacagttggaaggaaggtagagtatatgcaaggagaaggagacaaacaagatgctaatgcaacagggcaccaaacaccaagaaataagcaagtaaaacatggagcgggaatcccagttttttgcagaagattaaaagagaagccttgagagacatgtatttggtataatacacaaaatatcatcatgcatttaatatagggagtgagggaatgaaaggcatcagaaataactttcatctctctggcttgagaaacattgagtagacaatggtggcatttaatgagataaggaaaatggagaataatatattttatcgaggtagcgagttgaaggatgatatgaattttgaaccactgagtttgaagtgcacttgaggaactccaacgtgggagagtgttaaatagccaatgctaattagaaacattcattgaaaaatgtatttttaggagaaatcatgacattaaaactagaaagaacatatttttgaataataccatttatattaatgtctgataaacagatacaaagtgcctaaaggattcttttttataaattattgatcattcatttaaatgatactagattagagaatatttacatcacctgctataagagtgacagcatattagccaatggtattcatgctcgactatgcaattcagaagcaacatcaaagaatattcttcattgtgttcataaactttctcttaagtgaataataaagaaaatgtaatgcctagcaacattttctagcaattattcttctgcaatgcatgaatacatatttgtgctattgtagcattaggttcaacctaattaactcagaaaatcatttatgcacaatagcctatctttcatgtacagcagatcatgtacattttctttactttttgcaagttgtatgtaacattagcacacaaaaaaatagtggttgtggttctcggttcttagcactgctgtttatcacatccatgtccatgctagtttttccatgtgtgatttaactaccaagttaaccatttgagattagaccatctcttggatttatgactctgtgcctataatattcgagctgcctataggtctttataagcatatatagcaacacatgttgtcaacaacaacaactgcttagatattaaatagctgaaacctctggaattaggcaaactgtgtgcaaatattaaatattgcttcagaccttgagaaactttttttcaactacctgtgcacatatttcctcacctgtaaaatgaaaccaatgataaaacagaacctccttctttggactatagtaagaatttaatatttaatttttaacaaattcttatggtaaggacttaatatttaattcttgacaaattcttatggtaatgtttaattcttaccaaattcttatgataaggatttaatatttaattcttaccaagttattagggtaagaacttaatatttaaaatattcatttttcagcatatatgaagttcttagaatacctactagcatatgataaaatcttagagaaatttaacaattttattataaattagattgcttaatatataatcatgttacatgagttgagatagtcaatgcaaataaaaaataatcttcactggttatccttttatgttactcagctttcaatttctcataccatctcaaagaaaatgtagctagtagttatttttcagaatctgagaagtgttctgcaaatgtgcgtaataatttttgtcaatgttgaaaatctttaggactttctgtaaagtcgatatttaatgagttgaactattgtctttagcatttatgtcctaatttttggaaggaaacacacacacacatatatatatatataaaatgaaatcctatcttacttgacctaaaactgcacaaaaatttatatttgctgcgtttattttgcattggtaatatcaattttcttccatctgaatacaagtcatttggaaaattccttacatccaagttcttcagctcctatttgttaatcctttctttctttcttttcttttcttttctttttctttttcttttcttttttttttttttttttttgagatggagtctctctctgttacccaggctggagtgcagtggcatgatcttggctcactgcaaactctgcctcccaggttcaaggaattctcctgcctcagccttccccagtctggaaatacaggcacgtgtcaccacacctgcttaatttttttttttttttttttttttttttttttaagtagagacagggttttgctatgtggcccggctggtctcaagttcctgactttgtgatctgcccacctcggcctcccaaagtgctgggattacaggtgtgagccacctcgcctggactatttgttaatcttgatcttgttatatatcaactgctgggttgctccatgattttcacattctcttcctttagtttgtattgtgttggtttttgtttctttcataaaacactaaaaatgtttacatcattttaaaacatttcaaacataaaacaatatcctaagtagcttaacagtagagtccacacatgttgggtattaacgtaaaaacttttaagctcgttataagatcaatcagtctgttcatatcagtactcaatgagaacattaacatgttcaactctgttcagtcattagagaagcatatataaaacatattccaaaaatctaataagctgagtgaatgccaataggccagtaaatattgatataggatgttgctttgatggtaccaatttcattttatatattgtaaggacttccacctactattagagtaaatttcaagctatataatctcacattaagtgtcatttgcaatctgaacccaacaattcaaaataattatgttttaccaactctaataataataagacaaaaaataatggctattacttatcagtaagcaatctgagacctagtaaggatagatgacttatccagggtcatagtgttagctggtgagagagccaggagttgaaatgaggtggtttggcctcagaaactttgcactaagcccctaaatgtattaacaacactacgccaaagccttgccaggaagcgtttcaccatcttccagtgggaagccaagtaaacataaacttttaataaaactgtctgagtactgtcagagaggtataaacacttctaccagacagtaatttttttcaccatcctggaagaccctcaaggtcagggattatattttatttgactttgtattcccagagcctcccatgacacctaccccatagaggacctcattaaatgtgtgctgttgttttatagcaaagtgattccaaagcggtagtagggctagagaaaaaaaaaggctttacagtatgtacgagcgacatttgaactccgtcttaaaaaaataaatataggtactcaaggaagaaacacagagaagaggacatttgagacagagaaaacaacatgtgtgaacaaggcctgaagtgggagaacaatggatatatctaaataataggcgtttggatgtagggaagccagagatagtgtcgggcaagattctggacaggggtttgtggcggtttaggaaggaaaacctttatgtcaggctttcaccttcatagcttcacctgcacagccagggctctgttgcactggaatcagtagagggaatgggtacagtttcaagaagctctccaagagctgggaacaccctatttgtgcctcagcgtggttgaaatttagtctctccatttatgagcattacaaattttaataaaatgcaacaagggcacagttggggagaggttataaatgactaaaacaaaaggagattttaatattgaagagtatagaattaagttttcaaaaagttcgaaacagagtgcttatatataaatataaaataaataaatgtgattgacattaatttattaataacaaaacttgcaagaagataaatctgcttacctggttttaagcattgagaggaactaggagtttatatgcattttgggggaaatatatttaaataatatttttgtgtttacacagaataattataatagcttacagatagtaaaactatcatatttggggttattgtctcccctagacaaaatctataactaacatctatatttacaatgtctaggctctcatcaaataataaatagtgaagtcaacataggtaccttatcccatgtaattcattaatctttacacaagcctcttaaacagtgctccagtatgatagtaaaataccatgtcttccctctccggttgaccttatttccaaggttgagtatctagctagctagctattttaaacaagagcaacctaattctattgatttaaaagacagaataatgatcactgcaggagacagagaaagtgaacagttaaaaaagatgtttcactaagctaagggaggaaggagggcctaaatttagtgttggagattgaggttatgatacaaggtttacagactaaaaagcaataacatgccatgaagtagtttaaccttttatgttttcttgcctctgtacttctgcaccctctcacaccactacatttgtctgcaatatatttcccttatcctttttaaaataaagtttcacttttaataattaaaggtacataataggtatatatatttctatcttattattgatacatagcatttgtatatatttacaggggacatgtgatttttttgttacacgcgtataacatgtaatgatcatgtcatagtatttattccctagaatacttttcatctcaatgcgttaaaaatatttcaaatactctcttgtgtctatttagaaatatacagtacattgttgtttagtaactaaagtttactctcaatcactggaaattattctttctgtttaaatgtatgtttagacccattaacctactctctttatccttcccacatacatttcctagcctctggcatctagcatactagtctataccttcatgatattaccttttttagccccacatatagtgagaacatgtgataattgtttctgtgcctgatttatttcatgtaacataatgacctccattttaccccatgttgctgcaactagtgttatttcatgcatttttatggctgaatagtttttcattgtgtgccaataccatatcttctttacccatttgttggttgatggacacttaagttgattccatatctctgttattgtgaatagtactgtaataaacatgggggtgcaggtatctttttgatatactgatttcttctcttttgaatagatatctgttaatggcattgctggaacatagagcagttctatatttacatttttgagaaatcctcatactgttttccacactgactgcactgattgacattgccaccaacagtgtataagagttcttttttctccacatcctccccagcatttatatatattttttgtcattttgataatagccattctaactggggcaagatggtatctcatgattttgatttacacttccatgatgattagtgatattgaacattttttcatatatatgtaggttctctgtatgtcttattttgagaatgtctagtgcccattttaacaatgtgttgagatccttgtataatctggatattagtcccttgatgaaagagtagtctgcatatattttctcccagttctacagattgtttctttactctgttgattgtttccttagctgtgcagaaatttttctgtttttgttgcttgtgtttttttaggtctcagccataaaatctttgcctagatcaatgtcctgaagtgtttccccaaagttttcttccagtagttttataattttgggtcctaacactatgtctttaattgatcttggctgatttttctatgtagtgagaaataagggtccttttcattctttccatgtggatatctgatcttgccaacaccatttattgaagagggtgtattttccctagtgtaggttcttggtgtctttgtcaaaaatcagctggctgtaaatacacagatttatttttggacaatctatttctgttttatttgtctgtatgtctgtttttgtatcaacattatgctgttttggttgctatagccttgtaatatcttttgaagtcatgtagtgtggtgactccagttttgttcttttcactcaggattgttttgaatatttggcctctttatgggttctacataaatatttttctatttttgtaaaattgccattggcgttttgatagagattgcaatgaatttgtagattgttttggtatggtcactttaatgatgttaattcttccaatccacgagcatggaatctttccatttgtttgtgtcctcttcaattgcttttatcagagttttgtaattttccttgtagaagtatttcagctctttggattactttatttctaggtattttattgtagctgttgtaaatgggattgccttcttgattcttctttcttagctaattcattactggtatatatgaacaccgatttgtgtatgattaatattgtatcctgtaactttatttaatttatatatcaaatctaagaaattttaggtaaaatgtttagattttcctagatagaagattatatcatctgcaaagaggaaaaatttaactttttcttttccagttcgaatgccttttattttttttaatccatctgatgatgctggctaggcctttgagtactatgatgaactgcagttgggaaagtgagcatctttatttttttccagttcttagaggaatggctttccactttttccctttcagtattatgttagctatgagtttttcacatatggcctttgttatgttgaggtatgttcatcctatgcctaatttgttgagtttttatcttaaaggatgttaaattttccctatttctctgtgtctattaagatgatgataagattttgtccttcaccctctttatgtgatgtatcacatttattgattagcatatgttgagcaatctttgcatctgtggaacaaatcccatttgattatggtgcattatcttttgttactgtttgtttcaatttgatagtattttgttgaattattttgcatctttgttcatcaaggatatcaagctgtagtttttttttttttttttttttttttggttattgtttttagactcttgtctggtattggtatgagggtgatgctggcctcacaaaataaattggctgaaattccctcctccccaaatatttaaaataatgtcaggagaaatggtgttagatcttcttcgtaaatttggtcaatttgtcagtgaagcaatccagtctcaaacttttctttgttgggagactttttattgttgatgtaatcttattactcattgttgataagttcaggttttctatttcttcctaattcaatattggcagattatatttttccaggaacttgttcattttttctaggctttcaaattagttagtgtagggttattcgtaatcgtctctggtgatctcttgtatttcagtgctatcagttgtaatgtctccatttttctgatttatttgggtcctctttctttttatcttcattagtctagtgagcagtttataaattttatctttttttggaaaacaactttttgttttgttgaccctttgtattattattttcagcctgtattttgtttagttccactttgattttttattatttctttccttttgctaattttggtttggtgtgttcttgcttttaaaatttattgaggtgtatcattagattgtttatttgaaatctttctactttttaatgtaggcgtttattgctaaaaactttcctcttagtattgttttttttctgaataccatagtttttggtatgttatgtttcaattttcatttgtttcaatacattttttgattcctctcttaattatattcttgacccaatggtcatttagaagcatgttgtttaatttccaaatattaatatagttttcaaagttcttgttattttttattccactgtgttctgagaagatacttggtatattttgattattaaaaaaattgagacttgttttatgtcctacaatatggtctattcttgagaaagttctatgtgctgatcagaagaatgtgtgttctactcctgttggatgaaatgttaggtaaaagtattttatgtttattgggtttaaagtgcaatttaaaggcaatgtttcttttttgatgtttttgtcaagatgatctgtccaatgctgacaatggggtactgaagtcccccaaatattacattattgcagtctatttgtccttattgatctaataatatttgttttatatgtctgggtgctccagtgtttgctgtgcatatatttacagttgttatattcttttgctgaatttattcctttataattgtataataaccttgtctctgctgtttttgattaaaattcaactttatttgatataactgtagctactcctgctcatttttttgcttccatttgcatggaatatctttttccatccctttacattcaatctatatgtttctttacaggtgagatgtgttccttgtaggcagcatatggttgagactttgtaatttttaaaattcatgtctttttgtttgtttgttttagattcttgctctgttgcccagtttggactgcagtggcacgatctctgctcactgcaaattccacctccaaggttcaagcttttctcccacctctgcctcctgagtagctgggactacaggcacgcaccaccacatccggctaatttttgtatttttgattgagaccagattttactatgttggccaggctggttttgaactcctgacctcaagtaatctgcccgcctcagcctcccaaagtgcagggattacaggcatgagccagcatgctgcccccatccctgcctttttttaactattaagccagtctatatcattgaactacaaaatttaatcaatttacattcaactttatttttatatgtgagggcttagtcacatataattcaccacacatacatgcaggtggtggtgaagtcttgctggggacagggccatcaggtgggccagtctttggcccccattggcggcagtgcaggtcaattatgtctttccctaattttcagggctgcatacactagcactggtgtcagcaggtctatgtaagcaggtctatgcaattctgttgtccctgtgtggcttgcttgggtgttggcagtgacagtgatgaactgggtgggtgagtgggtcctctggctccaaggcagtgggtttggtggtaatagtagtggagggtcaatcctctgactctcaagccatctgtactggtgttggtggtggctgtgacaggctgcaatggccagtctctaggcttgcagttggtgcatacatgcgggtactagctgtggtggtagcataggttgagtggactcattttcaagcccctggaaatagtgctcagctgctaatagtgtaggtggggcaggatgatacacaggcccttgaagggtgtgcttgtgcactcaggagggtagagctacatcacatgggccttccctcagccccccggtagtgtttacagtcactggctgtggtatacaggggtggagtgatccccaaacccccaacagaatgtttagatgaaggtggcagaagctgcacttgcagcactgctgtggggttggggtggggaagcagaggttactttcagttttagtacacacgagcagatagctgaggaatgcaagtttcagccctaggtgacagctataaaccgggcagcctttcttcggggtgcttttaagcgtgtggcgaccctgctgctaaaggttgctgggtcactgtcagtgcctcatgctttggtcctagcaacagtagccaccagtggtgcctggctgcaggtgggggaggtcagtggcgttctaggaatctggagaggcagaagttggactctagggcaggatgcaaactggtggggactgggctctcaaaatagcactctgctgtggctgcttaggcttcagtgtgggtatggcacccattcttaactcccttcccagagcaatgctcttgccatccccatgcagcttcctatgatagtttcagtgcccatatgggttgaaggactctaccatggctaagatttcaggaatctgctgtggaaatgtggaccactggggagcatttgcttactctttctccagactaaggagcctctgcatactccttgccaattgtagccaagcgggctgcctcgctttggtctcctttcttgccttaggtgttttctgtcacatctctgttgaattccagcattttttcttaggtgatctattcaaagtgtcattatctactccttattttgtgaaggaggtgagtaccggatgctttccatcagccattttgaaggcgccccttcatctctttattcactgatcaggtacaaagacccttgaaaaatgaatgggttaagggcatcaacaccccacacaattgaaaaaccatacgtgatttttggctactccaaaaattaactaatatccttcccttaactagaagtcttactgataatatattcaattaacatataatcattctgtatgttacatgtattgtacaatatagttttacaacaaagcaagctagaaaaaatgttattaagaaaatcacaaggaaaagaaaacatatttattgtgtattaagtggaagtggatcatcataaagaacttcatcctcatcctctttaagtatgccaaggaggaggaagaagaacaggggttggtcttgctgtctcagtggtggtagaagcagaagaaaatccacatataagtggatgcacaaagcccaaacttgtgttttttaacagtcagctgtattttttctaaaaacgcttctcaggctatccaaacctaaataaacatgtatttattttaactactgtagaaactattgccatgcaatcatttagcaattactcatacaatgtcttatattagtttctgttttatgtgagcagctatttagatctacttttgtttaattttctgaaattatttaatagaagattttatactattggcatatagtaggcatttaaaaaatagctgacttattgcagaatcttctattttaaattttatttatattttttgattttttttttactatagaatatagtttcctgcatattcattacaaaaacatgaggtatgataaaagagcaaagtgttatatttaaaattaatccttcaaacaatgaatcaagtgtaacaatatttccctaggtcagaaactttaaaatacttaattttataagttaaaaagaatgttttggtaaatactgcaaaatacttttaaaattagagctgtatatttttaaacatctttttttcaaaaaagtaattatacatattttgagtaatgctcagtcatagcacagaatataaaacataatttttatatgacactctgatttatgagagcacaaattactttttagcattaagccagtgcaatcatgtgggtcaccttccaaatataaagaaatagggggaaaggaaagtgggcaacttagtaggctatgaataaggtctaaaagagtgtgttcttatatttatgttacaaaaataaagtgtgtcctttttgaaaacaaatcttaaatatattttcaggcagattctacatattgttctgctgcaaaaaatgttgttttaacatgtttcccctaaactgcatgacttagaactaaacataaaaatggtatttggttgctgttccaaatgttatgcaaaaaaaaaaaaaaatcaatttgatgggaaaactagacaaattagtcagtgggaattaggtttattaagaaatttcacctaatttttgttgcttttaatagttgcagttttaactgagtgtgaagaaaagttgccaagatgacatatgtcacatgtttcttcaattcatacatcctcaggcactagccaaaagccactgtatgtgtgtttttttcaaaacccacgtatgaaacaacagaaattcctttaataaataatgattgttatctactatgtatcagccaatgtgctaagcattggaaccctcaagaacgtcatgatctgcaaggaacatataagagacacaaatccagaaaaattaaaattaaaataaaaacgcatggcagtgatagcaacaggcacagtggattgtcgtcaggaaggacgtggggtcaaaagaagatttcagaaggaaataataactgaccacagttttagaaaatgggagcgagcctggaaaggagtggacaggtgtttatgcagacagagttgcacataggtagaggcatgggaagagaggaatgaccagatggtaaaatatatcctatatacagaggagcatgtaaattatcttcacagttgaaaagagttattttttaaaataaactcttctataaccattcttcaccatttttagagtaaaaaattgttgatttaaaaatgtgaggaaacacagacttctacataattgtgtactttgtttcacctaaatgcaggtgacagatagacctcagtgaggtggctttctttttaatacagaatttttatagatcagttttagataatggccacaggagtcattaagagccggaaaatggtaagaagagacaacactagcttaaagtgaatgcaaacacatactctttgagattttgccagatacgagtcaaaaataccttttgaggaagaagttctaagaaagtaaaacataagcaagaatatcttttttaaggggatatttggaagcatattgagcaagttattgccaactaaaacatatccaaagatactggatattgtccttgataaatgttctagaaacttttaggactgagaaatactagggtaagcaatgaagaaagagttggagagaaaaaatttaatggtcattttgtttgagatgagaatgaattttctcgtctgtctctctgtttctgagcacgctatgactgtatgcaagattttcctacttaacttcacagttttccttctattttattgttaacacttccattctcactaatgtggttggtaaaataagtactttaattatttgcttgcacattcaatattaaaataccatgctgtcttcagtttattatgagttcaattttcaagacactataaaaataatataacaatccattaaaagggtattctaaaatattttgtcattaggttattattttattatcttcaagtaaacaagaaatacatgagtaaccctcagcatattataaaaatgtgccaataaatttaaagaaaatttataaacataggaattctaataatttttctatatacatgaaggtgattattccaaattccattagattttctaaagtattatatattttgttatttttaaattctctataaacataattgtgaagccactttaatcaaataattagaaacaataatttgcaagcttgcaaaagaacacattacatatacatcttttaaacaattaaaatctaaagagtgattcctgataaagtaaatttagtgtaaacagaaatgcaaataaataaaactttcatttctatattcgaattgcaaaaaaatttgcaataatgaatatgctatttttcttgcttgtaaattatggtcaaaagatgtctgctgaatccatcacaatagtatcctaatttctcaactagaagaaattttagcaataaaaattaagtttagaatgataccaaagcttagattcttcaatacaaagaaaaaaaaatagtctcaaatcaatccttgttttacagatgaggaaaaattggatccaaaaatattaagtgatttgttcagttatccaggtaggaatttcaggatcaaaacaggaattgggtttgttatgtcaaatcctatgctaaagcctgtaaataagcttcttccaggtcattaagtcacctctatgaaagtatttatctcagtagttcatatgatgacgatcctttttaaatgtaatcaactaaggtagtactccctaaggatagggttaaacacagcaggttctcaggacaggctgctgataaatagacagagatctaagtgtgtagtaaggaagaacagtctatgactgagttagttaatggacgaagtataatccataggaattttttatatgcctttgaattacataatttattaacaaaacactaaacaaaacataaacctctctgaagctacaaatgtcacatgactgaaatcctggcatattttgctaaatagaatacagtaaacaatcaacactgattttgataaaatgtttcgaggtttttcaatgaaacaaattctttgaacagagtgaaaattaatttttacagattatatcaatacaaatgttacataaaacaatttcttaaaaggaataaaaactaagttctacagattatataaatacgtccaacctcttttacatggaaaacagtatgaaatttagcctattctgatatgttttcacaattttatataatctacaacttattctcctaaacttttttttaatgttagacttttaattgggctacttacaacaaagaacaaaatgttttatcatacatttttccaagtattttatataagtgtaattaagtttcatcatgcaggttcaagtcgcattgccacgattaagtggctgtgaactattgatttgacttatttaacatttcagtaacgactaatgccagtgattattgcactgtatggaagttgcaaaaaataattataatattcaacgtttattttacttgaaacttaaaactttatttaagaacatgaccagccatcttaatttaccttctaactaaatcattgtttgagttgtatatgtttggaaaatttatgtaacatttttaagccttaatatcactatttataaaattccgattacaattcttacttgcaagatccctatacatattacagattatgcatgtaaagcaactaataaagtgtttggcacccaaatcttaattcacttgcatttaatcatgctggacctatacagacctttaaacagtacagcaattataatcatattatatttttttctgaaatatatcttatttatacatatttattcagataagcaaaacataattagcagaaataaaaatcagtgtcatttattatcatttttgcattgcctctgagggcaagagatttctattagaaaactggtatctgtgatatttatggacatagctgcaggtaaagatgatgatgatgattgtgcaggaatgccatatgaattatttcaaaagtggtaataaacttatattgatccatttttacataaactgtcaacaaattcccccaaggccaggccttaacccattatatatatataatgaaagtgttaaagcttgtagcataggtcctggaagtgccctataaatgtaatcactatgcatattggatgtaatcactatgcatatgatatatatacatatatgcatatatatatgcatagtgattacatatatatatatatatgcatagtgattacatttatagggcacttccaggacctatgctacaagctttaacactttcattcataataagttacatggtctttttataacactatgataaggctattttctctacttaataaatgaaatacttaagtgcctgactgaagattacacacatagcataaccagattgcaaatatagggagtctgaatccacaaggcatacactcaaggcccctcatgctgcctgatgttgctgctgtagaaaggacacagataaatagaaagtaccatgactgactgttgtctagagttctttatctctgtattttgaaatcaacagattatctaatggattaagataacataatcattttctttcagatgaacagctgtgatcaatttagcaggtggtaactttttttccccagtgaaatgggaaaatgttagggtacattacaggtaataaggtaaattatttgataaaattttcatttcagttgcatatatgcatgtatgtatactggatcattatataaaaggtgtttcttttaggttataatccaaagaagttttgaaagctgagtttttttaaaagggtgatcagaaatttggaggaaagacagaattgtttgttcataacatgtactttcaattttgtggttatgtttcaactctttacactatttaccttcagacttctagaaaccttttctacactccaggttctttttgtggtcatctgttattctgtggtcatctatgaatgaacaagcatacaggcccatcatggggtcaaacctgtaatcctgattccatcatcactcttctctcctatcttcaatttgtcatcaatttctaaagatatattagatttgcattcttctttccagtatcaaattttcattaatttatttcagacaccatttctctttccttaatttctgttccaacttccttctttgcctccagcctatcttgtttaatccattctccttagtgctactgagggagcctcctaatccataaataggatcatgttacctccctgataatttatttacatctttctcattaagctgacaataaggtgaggctcttcatggttcagctgtaacttactccagccttatctctcagaactcatgacttaaatactacaaaatagttcatgcaaaaatctgaaattttctcagagtactttctgctccatttttctgaaaatgttctcccttttcctttcctcacacatactcctctttggccaattcctacatatcctttagtcctcatatgataagccattgctcaggaagccctcctggatcctttatttcttggttgggcatccctattagtgttctttttatttttattactgttcctataacaacactcatcatgatgtgctagaattgcatctctacgcatctgcgtccatcaccaaacagtaaattctttgagatcagtgagtatgtgttttgcacacagagtatggcatagggcctgttgtgtactacattcttataaagcatgtgtgttgaatgaatgaacgaatatattttttaacttttattttttcttcttgagacagagtctcactctatcacccaggctgatgtgcagggatgcaatcttggctcactgcagccttcgacttctgggttcaacaattctcacgcctgagcctccccagtagctgggattacaggcgtgtgccaacacgttcaactaatttatgtattaatatattttagtagagacaggctgttctcaaactcctgagctcaagagatctgcccaccttgtcctcccaaagtgctgggattacaggcatgagctactgcactcagccaaataaacaaataatttttctttttaaaatgaaatacttacttggcagagaccacctactgttacgcaatcattctatagtctttaaaatctaacactaatttcaggtatcaaaatttatatttttaaatgtttatatatttattgtcatgtgagattttatggtggtcaagttcaaagggcccaaatatctagtcgccctaataatattttcagtgtttttcaaaagcttacagattttgatcatttactaatgacactccactgctcactcaaagctacactgactagcacaaatatcctgcttctttgcttagagtgaggctgctagttggcgcattttgatgagaaattccaatcggcaggcatatgcagatttggatattttttaaaaaatgaaataagacattttaaaagtaacaggtttacagagaaaaagtttactaaaacaggtcctaaggaaaaagactttgaaaccagttacctagcaaactataaaagctaaatgccccaaattgtaatgatagccagttgcaccaaaattcaatgttattcatattttatttttcaagataaaaaagttactatgtattgccaagtttgaaactgaatgctctatctcattcctttaagccaaatctttacaagaaaaggatttctacttcaaaagaaagtgacacaatactcataattaacataaaaataagcatttgcctaatttcaggagagtacattaagtcattagtataagtggtgttttgctttgcactctctttacattattccatctctttccatctgggagcaaacttaacaagcaatttaaaaataattggtgaattaaattgtcattggtggcctcattttcctttttcgcgtatgtcttcaacagacttactctagcagtaccattaatacagctgcggtaaaaaaaatctgtgcaaatggcatgttataaaattaaatggtaacatattgtgttgcttgggatcacagtcaagtctagaggcaaaatagaaataacagatgcaatacaaatgtagagttattatgtgtgtcatactggaatctagcctcacaaaattagcacaatatgctctacctgaggataagctagggaaaagaaaaaaaaaaaaaagaaagaaagaaggaagattgtgccagcaacataaatggagacatagaaacattttaatcttaatatggtaatacgttttgaaaagaaattgtacatagattttttatttaaaatttcagaccaagagaaatgccttctatattaatatagttctccaaaatgttttttggatcatgaaatttctgacattccttttgaatttagtgaatttactagtttgaatggtcctaattaaattcttccctaaagctatttacagaggtacctcctgattttattagtcctttagtgatgctgcatgtctggtttggagagtaacttccagcaaatgaatagtatttatgcttaaaacttaaatgtgtgtgtgtaacatattgaatacgtaatttaatataatatctttaatactatgctttactaattatctaatttatgtgtgatacatcatatcatcatatagctgcctgggtttgttttgaattgtaatccaaaattaattatctcaattataataacttttatctttacattaaaaagtaaaagatcccttttcctcatcctcatagaaaaaaataagaatgttaaaaagaatcaaaactatgttttttggtgaaattactggctccatttatttgccctcccgctacttatgcttttttccatataactttgcagttccttctctaaaaattccctctacttacccgtttctgaacaaaaatatctcacttctcacagaaaaaaatgagggatttgaaaaaataatactgttaaattatataaacatatagtaagcattttcttacaactgtgagtgtaaatgatgtcacattgcatttactatccaccattcactacctcacttcaccgcctcagctaccacaactctcagaataagtacccatctccagaaaaaactcttgagtctgtttttagtgatttgatttagatgagtgttaaattatttgcctcgaaatataattatgactcactagagttgaaaataaaaattactattataatgagttctatgagctagatgaacaagtctacacaccatttgtaaagtacagtggttttgctagctagttggtagaatcacgatcaagtgatgccatcttggccagccatcagcaaactgtaatagctgatactgataattatgaataacagcaaacttgaaaataattacataattaaatacttatttgtgtaatgagctgcttttagaatctatgccagtgggtcaagtaagaagaagtaattggatcagtaggagacatttagtagttaagagacttgcttgtgcacacctaaaaactcaatggaggttaagtagcatatcactgccaaagagattctctagcactggtgggcctcagcaaaaccgtaagtggccttgtgagactgtgggactttagcacattactgcaatagactcataatcttatctaaatcaaagactctgaaaaaaagtgttatttgctacttaaaatgcaaaccattctacttcaaaatatatagaggagaaagaggacttgtcccaagataaaatgtgtcacatttgacaactatcaaccttatcagagtctaaaacttatatgaatacatgctgaaagtggatgctcttagttgtatttatccccattattaaacctaaatagagaagatcaaagccaaggactggaattttgaattattagtagctacaaatttctttcttaaagctttctggggcaagtgattgtcaacttcatagagtagaaaatcaaattaaaatggaataaatattattattctgaagacaagtgttccttttttcatagaaacattaaaagtatttgctaagtatgataaaacacgtatttctagaaaacagcagatataagacagtgattttcatttttttctatcgacagtataaacattagtatagaagtatgagagcccgtattgctgatgtttggagactaacattccttgcaaagagatgtctatgtcctttccaactctaataatctgtgattctataatttgatattaagcgaagattttagtaacacctaatttctgaattgaaaagaatttttaaaattctcacccacttactcaatacttgattttcttctatatgaatagcacagtcatatagttcatgcttgagccaaatttatattagcctaaatacatttttgatgaaatatttttgtttcacaaaaattcttatattacaaaattttctctaatatatatatgcttactgcattttaaatcggtctggcgctactggaaattgcttcatattaaattataagaaatttaataatcaataataagtatttggctgggttaaccatatttcttacataacaaatgctgataaatatatgtgtgtgtgtgtgtttgtgtacatactcttgtcaaattctaattaacaaaaatgtttaaaatatgttgataaatgcaaataaacattcacaatattattatgatttcatacatgttttgcatcaaaaatggcaacttgctattatattaatagctacattttaattggggtctcactaatctagaggctactctaatagcttccatgtattgaatgcttcctttgtctggaaagatagacttttatatgttaacattggtaatttctgggtgatgggactgcacatcattttatcttgtaattcttgattttgatatttctacaatgaacaaacattaaaaacacgattttaagatgttataaaatatatattatcctatttctcttttatttttatttttcaatagtttttaatttttatacaagctttggtcagtgagtaatggtacttccacagagtacataagatttcaatgtccaaagcaagtcagtctgtattgcatatattcagagctccatcaagtaaaattcaatgttaatacagaggtaagtgttaacagagaggaacaatgaaaaatcctatttaggacctgacttcaaatctcataagggatcagaaataccactgtactgctgaaagtgttttcctaggaaaaacagttttcatagcatagctcgctgagaactaactgatttttggcaattagatcacccatttttgagttaaaaaaagataacaattgaatatcatttgaacttctaatacctattaagaaaaaagttatttaaaaatgtttggaatttttggttggaaatctatgcagttttgaaattaaaatatcgattgtgagaatagtctcattcaaagttgaaatacactcttcagtaacaaaataatactgaaaagggtgagtgcaatgacaagaacatcatatgaacagatattatattctggaaaaagtataaaagcagattcaagtgatagagattgatatcccaattaaattaaaagaatgcccagaaaatcagcataattttcaataaaaatgatactttattatgagtaggtaagtagagagtgtatttatttagatgctccccactggtgtccttgtgaaaatggatgtcaattgtgtcaataataagcaatgctacttgcacctcaatttctcagaaggtgttcaggaaaagaaggtaccaggtaccttagcaggcaatgggaatgaggttgggatatttgaaaaataaaaaagggaaagattaactgaaacacttgtaaggagatttagatctccaaaattcttctttaactcacaatcaattgacttcagatttgcctatgcccatatatcacccctcacacatcaagattagaagcaagcacatatagcagtggcgaggtagtgaatagaacaaagtagccatttgtagcccagaatcagaaatgtaggaagtgatccagagaatagagcttgcatactgactgcagggggactatgcaaggagtaaaatattaatttctaggcaggtaccagaatctaaacaatgataagcaggtatatatctaccagctatcagaaacaaacatggcagagattcaaagtagagagtcaggcagactaataaaagataacagtagtcaaacagtatagaaacaatgtaatgatcacaaatgattctgtttctgccatccttcttctaaaattctatatgtgacagaaagtctaaaatgaaacaaaataatatggaaattataattaaaaattattcttgactgagttacagtcaacatgaacatagggatatggacaacagcaacattagaggggtcatatttgcagggtctttctggagtcaagtgaatttggaattacaacatggtatgtgtttaatgctcagcaattatgttatgagcaaacaacaagttatattggtgtgggattttgagcaaaattgctttatttattttatttattttatgaagggagaggaccaaattttaaatttcagttgaggctttccatttgcagaaatggtagattttcattttaggaatcttccattagataatgtcagctcctaatacttctcattctcttgtaatttctttttttattaaattgagattctcagtgaggtcatagtgtaatggagaaaaaataggtctgcgagaaaattgtgatgtctttaccaacagaaggtgataggatcgcaggtgataaaaacaaatgaaataaaagaaacagaaaacctaaagaaatcaatcctatactttgtccactccattttttttctcctttatttcttccactttttcttttgaaaggtacccttttagttccaaaaatgtagagaagagtatattcattattttagtttttgttttctttcaattgctttaaaatatttttctatttgatcctaacattcaccctatcaaaaagatattttgaatgttttgacaaataagggtgatgatgttcagatttcagtgatgcacttagtaattagcagagcctgtatccaaacttgagtttgacacatttttaatacctatgctattccttacaagctatgttaggttatagatgatttttcccactgtccaaaactaattttttatgtccttcataatcttcagaaatgtgttttgccactttaaggaggaaaaattgtctgtaaaatccaaaacagcaattttgctgttgcaatggaacccaacgagtgatgccagcccactgaattgaacagaaagacagtgatgattctttgtgaagagaaaaaatatacatacacctctataatgtgaacagagcataataagtggcatttttgcaatttggctgcttgacatcctgtgtgaagttctgaatatcctttttttgagcataaagcaaggacatggctttttttccccttcatgcactcaagggactcactcaaacacctaataatgctgttcaacctttaatacattcataatggaattccccagttagcgtgttttcacttgcctgggtagaggcaccagctacaacctcttcaaatacttaaaagaaaatactgttcacattaattgtaagaatcttcaaaagaatgctagaatacctcaaatggaaaattcacaagtagtagcagacaagaagacatagagcataggagtgaatagtagctataaatcagatacaagccacattaatgaattgagataagaagtgtgaaataaaatcgatccccgctcatcagagaaggaggagagggttatttttaatcttgggatgaatttaaaatcaataaaaaagtataatagtctcataaacagaaatcgaacgacaatgcaaggagttggaaaaaaattaaaaacaaagggaaaaaagtacaccaatttacttcaacagttacaagaagccttgtttgatagtgttaactgtattcataatgaacatgtgtatagagccttttaaaacatcccatcaagcactgcacagctgaatgtgaccactcaaataatatttggtgaacataaagaagaatgcccataaataataatcttccaagtcaaacatcttagatctaaaagttaaggctacaggaagagtgagaactctttgtgtgaagacactcataattaacaatatataagcaactacataaggctgaaataggcagggattgtgaaattccacaatatgagaacacttattttcttcttttcctctcataaattttgttcagaataccaatttggggaatcaagcagaagtaatccctgctaatagtgctgacactatgtcaaaagttttgagcaataaaaaaaaatctccgactttctatataccagaaactttcattttaccctagaaaatcaaaggacccctttaactaaaaatgtgtttctagaaaagtgttccaaaatacgtcatatggggatctagctcctcagccaagcaattgagcctcttttccttttgtaagcagcatatcaaagtaaggccaaagttggatactaagaaaagaatggagttacttatatttaatatttaggatacaaaataagagcaaagtataattgcataatgcttgctacatttcaaatttgtctccttctggaaggaccttcatctctgctccctgaaagccaaaaacaacaggctactatttttgtttttcatgaagctagatattagccagttgctagacttcaactgtgatatattcatgagaagacacaagctggagaatttcagcctagtctaagcaggacagatggagttgctttttacctttatacagatcacgagtttttagccatttatttttcaaaagtctagccttcagcagggagcatccatatgcgtgtgtgcaattcacattgagttctgaaacaagacttctggtttatccataaatctggcaaaataaattctcgaggcatagcctggcaacaaagaacttgaataaattctttaaagctcttttgtagtgaaataatattagaagttggggcaaagacaaagccatgagaggtgttgatctctaacagttttatgaaaagatgtttaagtaacttttcagtggcatcaatttaaaaatctagtcaatgatgtaacgttgaggatggagtttgctgacttttatcttccatgagcagtcagactaaccaggtgttagtaatttgaatctaagcaataaagactgtgaagccacattgatatagttaccataaatgggaatcagtgagtcccaccagcgtcacagagaacaattcagtcagtagcttgggcagggccctgctagtcattaacaactccattaagctaagacagaaactggaagcattgcccagagaggtaatcagaagcactatgctcccaagactttccttaacaggtgctcattttcatcctggtaagatttagaactaagcatatacatatttaagagaatcatattagagtatggatatttgaaatctatcaatatttactattttatattcttaaaatatttcagataatttgcctttttgaatcacatttgtacttatgatgtataattaagtaatttacatacagttatattaaacttagatctattaatttcacatagtagaggctactagttattcccaaatatgttcattcttcctttctttcttcctttcccttccttccttcctttcttttctttctttctttttaaaatactgctccttcctgtacactgattttttttcctttcttgttagcagtaaaaatcttgattttttttgtaagtctaaaagactgtaaaaccttccattctctgctcagttatttgtgatgttaggactgagttctaactacttaaatgtatttatagtgctatataaaacttccagaaagcatctttgggggaacaggggcttgcccttttcttcttctctccattctctttcttgggactctactttaatgattccagtttaagcagccattatagaccatgagattaaggattagaccgtggccatggaataatgttgatctgggaggaaggtgagttaatgaggtcttcagagagctgcagtactagctgctggtttcatatatctagacttctttcataaaacgcaaactgccattcatacttgtcattattatatatttgggaggttctatatttcaagaagctaagccatataataaatagtttgtatttaaaaagtcagagtattttaaaaggatatatgcataatggaatactattcagccataaaaaggaaggaaatgatttctttgcagcaacatggaaggaactacaggccataatcttaagtgaaacaactaaaacacagaaagacaaatatcacatgttttcacttaaaaatgggagctaaataatgtgtacacatggacgtaaagtgtggaatgattgaaaatggagactcagaagggtgaagaatgggattggggttcaccatgggaaattaattaatgtatacaagtgtgtgttattctggtgacggatacactaaaagccctgacttcaccactacccaatgtgttcatgtagcaaaattacactgttgtcacataaatttatacaaataaaaataaatcactaaaattacaacttttcccttattagctttatgaggtttatttaagtactcatgagtggtgtctttcagtcaaaataactacaaaggaaattttctatctagatttatataactgatataaaatatctctatagatctatccgtacatcaatatctatcaattacttctaaaggttattaactatacagttttctaaaaggatccacacattaatcaagtccccttctcctcttaaagtcatagtcaaaagttgttagaagttgctataaatataagtaaataatatggttttgtaggctaaacccagatagtaaaggaactaaactaatattgtaatgtcctagcctttcattttaaacaaacaataaaaatgcatatatacacaaaactgttttcttatgcaaaatgctgataagcattttttctaaaataaatcaaggtcacgtgatcaaagtgaagcttttgacaaattagactagtttgataacctgggttttaaagaaactgtatcctttttccttgattttagaagagaacagcaaaagataattataaattttattttaaaatataatgtgtatttttctcactaaaagacgagttaatatgaaattcctaaacttttcatactgttttactattgagctaacattactttcacatataagtaaaataaatttaaaactatgttttcaatcaaattagattataattttaagaaacatttttatagtaatggaatatagttttgaacttatattaaacccaaattaattggatacttggattatttttaactaaagtagaatattaaaatattggttaccagcgtaattttgacatacattcctttgattcttatttttacatgttatagagtagcaataacttagggccgtgtttgaaaatgtcttaatgtttgcctttttaaggtatggtaaaaaaaaaaatgtgtatggccgtcagatatcatactatatgtattcattagcatagctgtagtgttagacaaatctaaaccccatttcactccatgatgtagaagttaaatactaaaaattatgttaatatgggtaatttaaaatatactagaatcagtactggcagataagaagaattgtgtatgaaaagaaagataatgcacttttgtttattaagggaaaatgagagcagttttatcctaaagtgaagtatcagttattttcagatgtgaaatagaatagtaaatgataaaacctaagcaaatacaggaagtcatagtttttggaaacgagaatttaattatcttagattataatatcaaaaaataaggaatctcaaaaaatgtagtagaatatgttaaaattttcccaagagtaggttagttttcatggttggtcagttaatactgaaagcataaagaagcttgtgaatcttttactgccaaatattaacagcgcaaaattagactatttctattgaaataataaattaatcttgaattacttagtctgattttaacaatatataataattattttccttccatgtaaccttctgacatgaatggctcaccagagttgtttcctgtgtgttgtgctgaatttattatgccctggatcaatcaattctgaaggagctaagataccattaaattgggttaatactttctgtttatttaaaatattgtattttcccttgattaacttgtattcaagccatgaccttttattgttctcaaatactgatattaatattctaatcaagtgaatagatccctctgataactcttgacattttcttctcaaaattaattcctaaatttagaaaaatacaatttagtgtgccttttatacctaatactatcttcgtgatatctcagatgatcacagaaaaatcacaaatgtttgtcttttactctataaaaaagagtaatgctgaaaataattatagttgttggatatgctcctcatttcttacatagctcaacactatgatgagagctacaagaggagttgttaaacaaaagccttctctaagatagttttgttcaggaaaaacatatattgataattctctggagtgtagagtctctgaaatacatacatcatacacacatacaggcatacattagagagaagagagagatgtacatatacatattctggagactacattctggagatttataaatatccttatacttatttttaacctcagaacataattactaaatacccttatgactaaatatatattataccttaatagatcttactattctttatccttatgtgttggtcctctaataaatttgccatagccatttaattctgtctttgccaggttaagatttgcttgcttgcttgcttgcttgcttgatttcaactgtcctgtcttcaatttcaaatgaggaaaataatatccacaagtgcacctaggtaaaatgtttagttcaataactggcatgtgatcagaattaaattataaatctgatcctaaaatgaaaactcaaaatgagaaagcattaggattatatttctgcttctctgacatgaacactttataattaattgaagagaaatgttgagtggctaacagccagaggaacaagcatggctgtcaatgcatcttgactttctaattcctcatacaggaactttaaaagttagcatatggctgagcatggtggctcatgcctataatcccagcactttgggaggctgaggcgggcgaatcacgaggtcaggagatcgagaccatcctggctaacacggtgaaactctgtctctattaaaaacacaaaaaattagatgggcgtggtggcgggtgcctgtagtcccaactactcgggaggctgaggcaggagaatggcatgaacccgggaggcagagcttgcagtgagctgagatcacgccactgcactccagcctgggtgacagagcaagactatgtctcaaaaataaataaataaataataaataactaataaataaataaataatgtctcaaaaataaataattttttaataaaaaaatttttaaaaaagttatcatatgatatgtcctcaagtttatgttgaaaatgtaaatcacaggtttttaaactttgccacgtaacagaatcagctgtataactttaaaaacacacatatgccatcccacccgatccgctgaatcagaatgtctgaagtagagtattttacaaatcttcatcaaaaatatcaatgactagtaaaagtcaaaatactgatcatattaactgaatatttcatatgtagggctttttgtcaatttactattttttacctgaaataaatgattttgtgaagatataaaattaggagagaccattttacataggtgtattccaaaaatatcacctttccttaagtcagatactgaagtaatgctccaaaacccaacaattacatgttactccagatgcattagctttaatggcattgggtggtggtttaatttttagcccaccctggccagggatatttccttagtgacagcagtatggtctgcagcaaatgtgaactttaggaaatgcactaacgtataagggaaaggcagctatcagcattcagtcttctctgaaggtaagtatagcaaattaagagagatgtagtagaaatgcagtagcagttaagggatcaattcaaagttatcagaaaagggtatcttgtaggacaagttcaaagctgaagattgaattttaaatgttattgtgtgttacatgcaagtctcttctcatattttaaatttcttaacaaaatccactaacaaagtattatccctatgatgtctcaaaaaaaaaaagaaagaaaagttaaaaaaaaaaaagaaatgaaactccaagaaatatgatcaaattcacacagttaacaactggaaaattctgaatgtaaagatagctttttcaagtatctaagttctttcttcaacagtccacatagttttaagaaaccaaaactacattaccttgtaacttcccaggttaggtttatagagtagatgattagaaagtaataagttcttaagaggttaagaagagaaatttaacttattcctttgatattgctagggaagaaataaagaaagcagtggggacaatttcttgtagttggaaccccttatatcattttttatttttcatttttaagagcaatacagagaagattcatcaatctatgttcaggtagtaattgctttttactactttaagctcatctgtaaaaatcaaagtgaaactgactaggttttacgatattttctgaaaagtcaaaattctggtctttgctatcccttttaggaatatatggtaaaagtttccctatttgctcattactgattcatctgcataatgaagagttaaaatcttattgagaaatgccttgcaatcagttgagaatctaattgtacctgtttggaaaggttagttacaaaagcacccacggtgatccaaacttatattacacatcctctgattatcacatttaaagtaatatgtcatttgttattcatatttagtgttacaactctttaataaccactcaatctatttccctttaaaaggacagctgcaataacagcaaaattgtaaaccttaagtgtagcgtaagaattcaaggtgaaacacattccaagtagtagcttaaaatgtcagtatcatacatggctccctgaataaaagaggcaagacgtgtcaacctgaacagacattcatctctttgcactaaagtgagagatacaaagacctgtaccactcccagtagagagatgtgctgagacattcaagagtcaaagacgctcagctgtctgaggcaaatactgtgagtcttcaggtctctgtaaattgttctacagctgtgaaggattcaaagtaaaatttcagaatgatcataaatgaataaaatgtggtggattatagtagttactgtctttggctgtccgtaatttattatgttgctacttcttgtaactgtacagtagttctcctttattcaagtgcttgctttccatggtttcagttgcctacactcaactgtgttccaaaattattaaatggataattctagaaataaacaagtcataagtttcaaattgtgtgccattctgagtagcatgataaaatctgttacacctctccattccttttttatcacaagaataaggatgagtacagtactataaggtattttaagagacagactacattcacataacttttattacagtgtattgttataactgttcaatcttattattagggttgttaatctcttactgcctttaatttataaattaaactttatcccagtgtactagtctgttttcatgctgctgataaagacatacctgagactgggcgattcacaaaagacagaagtttaatggacttacagttccacatggctggagaggcctcacaataatggtggaaggcaaggaggagcaagacatgtcttacatagatggcagcaggcaaagagagagaatttgtgcagagaactcctctttataaaaccatcaaattttgtgagacttattcactgtcactagaacagcaccagaaagacttgccctcatgattcaattacctcccactgggtccctccctcaatacatgggaattcaagatgagatttaggtgggaacacagtcaaccatatcacacagttatataagtataggaaaaatgtagtataaatagggttcagtattatccatggtcttaggcatccactgggggtcttgggatatattgtctgtggataagaggggactaatgtattttcatttctctgggggtgggggcaaacaaaactcatagaatggatagattatggtgcctcctacacctacccaaccaagtgaaaccagcattttacatcagagtaccttattttcactgaacacagatattggcatattgtatcctgtcacccctgcatagaattttctaaattagaagagatggatacatctattttgctctttgattgtgaactttaaagtgtatgtttggagagaaccactctaaagagaaaacatctagagtgggagatgacaatcttaaacttcacccaaatccagtgaccctgaaaaaaaaaatgaaggttaagaaactcccccacccgactgtaaactagttcagccattgtggaagtcagtgtggcgattcctcagggatctagaactagaaataccatttgacccagccatcccattactgggtatatagcaaaggactagaaatcatgctgctacaaagacacatgcacacgtatttttattgcggcactattcacaatagcaaagatttggaaccaatccaaatatccaacaatgatagactggattaagaaaatgtggcacatatacaccatggaatactatacagccataaaaaatgatgagttcatgtcctttgtagggacatggatgaaatcggaaatcatcattctcagtaaactatcgcaaggacaaaaaaccaaacactgcatgttctcactcataggtgggaattgaacaatgagaacacatggacacaggaaggggaacatcacactctggggattgttgtggggtagggggaggggggagggatagcattaggagatatacctaatgctaaatgacgagttaatgggtgcagcacaccagcatggcacatgtatacatatgtaactaacctgcacattgtgcacatgtaccctaaaagtataataataaaataataataataaaaagaaactcccccacccttttgtattccagagaatggcttactgcaaagaatcaccctttcccatacaacttagataagacccacagatggatcccttttttatctatgaaaagatcagacacagatcctccaaattcacattgttgcctcataaatgattggctaaactgttttttctccactgattaactggaacaaaatagattttaaccaatttcggttaagtttctctctttctgccacatctctaaactttgacccatcttcagcctgaatcagtgtagcaattctccggagattaggtaggccgcagagtaaaactttctctgctctatgatgcagccaatcatgccaccctttcatgccacatataaccttacctacttctccctagaaaagacataccctttttgcctaacccttgtgaggctggcagatattatggtcatagtttttttctctattttaatagtccctttcttcacctcacaataattcttttgaatagggtctctctttgctaaatccagattcctctttttgactttgaaaatgaaggccacagccaaggaaagtcagaggcaaggaaggacaagaagtaaaagaggatgtcttggtggggttgaatccattgctcaattctggaggccctactttatgcagccctacagttgtctaacccacaacctttgactttagcatggagttcatgctctgatagctttcaactaaagcagccattctctcctctccccagctcttttctttctctgttgatacagataatattttgtatttgagggtctgaaacttttcaaaattcaaatgtcatggattgaaactactgtccttgcacagagtgtgagaatcaggtggtgtggggggaagtgctaataatggtctatgatccccagaaagcaacctatgttctaatgtaatttctacattcatattaaaatttagagatgattttatgttaataactcatctgcaaaagtgcaaatatatgtggctatatataatgtatatgaagcagtatgataaagtaaggagatatgtctcatgtagcaatgcaaatttgagtttaaatccctgttgtgtaatttttttctaaatagcttctgcatctataaaagaaaatatatctcctttattaagagattgttgtgataactacatgagataatactgacacgttttacatagaactcgatccataataagtactgaataaacaatatttgctactaccatttacattctaagtttaagagtagcattcagaaataagagaggatataatttccttgagaagaatgcccttgataatctctggtccttccatagagataataaaagttagagaaaggacaaatggggagcttttcttttttattcatctcatatttaaactttgtaatcacctttggattctctcttattaaccacctctaacttatcttcccccatccatgcaatatttactggatctatttcaggtctgtgtccaaaactttagttttctactctttgagttcaatgtcacattacttgtctctcaaatggatttcacaatagtctcctatttggtccttttcaagtcagattttgctttcacacactccactgaatgtgctctcttcttaataaaaaatctacaagcattcctctattactttaaaatcatttcagaaatcttaagaataggactctgtttcagataagggtaaaattctggacttcaagtaaaacatgaaaactagattaaatttcaggttattgtttctcacaggggaaatatgatgggaggattgtgctttacatatccttggaaagatgtttgccttgggatgttttttacccaaaacggtgactatagttatgttacctgcgactcaatatgcattcttcttttcttcttcactagtattacttcagtttggtcaggggctggcaattttttcaatttaaaatttcatttcctagatttacatttccatgaaactaagtttccaagtggaaacttccagtttcctggagaggaagtcctttggagagagttttgttttctttatgtagacaccaccactctttccttcttgctgcttccaccttcctcataatgtctgaaattaaggtctggggttttgagatacaggaactattttgcaaccatgaaacaagtcacacattgaagatggcacagttgaaagagagaagctgatactaggacatttgtgatagcatcaagccactgcatcacccagagctgcccactccagagttcattcaactatacaaaacaaacctttatttgataaagctaccatctctgaaggttttcttttcatgcattttatctgaataccaattgtgataggatgcccaaatagttttcaccttttctccaacatttatactaagctcaactctgaacactgcgatgatagaaatttaaaacttgagagagcttatctcagcctctcaatacttcccttattttaaaagttttaatggaaaaatttcaaacatatatttaaaaatagtaaatactatgaaatgcagtcacttatccattgcccaaactcaagattatcagcttacgaccacccttgttgtatccataactttacccgttctgtattattgtacatagagagggtaatgtatgcctaaacacattatcacattaccaaggaacacttattaacccacgcctcactgcagtgcactctcctgcagtcccctggcactggaccatagtgcttttgttggcagcacttgtgggagtgttactgccagtggacttggaatatcttggcctttccagcacatcaagcaattgacctcaaggggccagagaacaaagccacatcctggtccaagccatccagggttagagcaggaagcccaggagtgctgagcttagctttagtcccctgaaagcataaagaaagaaagccaattgactaaacccaatttgtaccacaggaaaaaaaaaaaaaccctcaagggcaccaaacaatataaaagcacaaatccccatccaaaggaaagaaacttcaaagattaaaagaacattagcccccacagctgagaaagaaccagcacaagaattctggtgactataaaacccagagtgtctttttacttctaaatgactgcactaactccccagcaatggttctcatgcagattgaaatggctaaaatgacagacatagaatttggaatctcgatgacatgtaacctcaggaagatacaggagaaggttgaaaccaaatccaaagaaagcagcaaaacaatccaatatttgaaagatggtacagctattttaagacagaaccaaactgaacctctggaaataaaaagttcactacagcaatttcagaatatgattggaaacaataataaagcattaataatagaatggaccaagctgaggaaagaacctccagggcttgaagactgtaccttctaattaatgcaggccgaaaaaaataaagaaaaaataattaagaaaatgaacaaaacttttgataaatatgagattatgtaaagagaccaagtctatgactcattggcattcctgaaagagttggagggagagcaaaaaatttggaaaatatatttgagaatattgtctatgaaaatttctccaacttgctagagggggtgacatgacaatttaggaaactcagagaaccccagacagagaatatataagatgactatcgccaagatatatagtcatcagattcttctaggttaacatgaaagaaaaaaaatattaaaggaagctatacagaggggaaggcaacataaaaagggaacccaattaggctaacagtggacatttcagcagaaactttacaggccagaacaaactgaggtcctatatacagcatacttaaagaaaagaaattccatctaaaaatttcatatccagccaaactaagcttcataagtgaaggatgaataaaatctttttcaaataaacaaatgttaagggaaattgtaaccaccagacctgccttacaaaaggtccatcagggagtggcaaacatgtaaagaaaagaatacctgctaatacaagaatgcacataagtacatactgcactgacactacaaaggaactatacaattcactctacattaataaacagctaacaacactgtgatgacataaaaccctcacatatcaatattgaccttggatgtaaatgggctaaacacagaatggcaagttggataaagaagcaagacctaatggtatgctatcttcaacagaaccatctaacatgcaatgaaacccataggctctaagtaaaggaatgaagaaatatctatcaaggaaatgaaaaacagaagaggcaaagggtcctattcttattacagacagaacagtctttaaacctacaattattaaaaaaaagatgaagaagtacattacataatgataaaagattcaattcagcaagaagacttaactatctgtaatagtctgttcttgcactgctataaagaaatacctgaaactgggtaatttataaagaaaagaggtttaattggctcatggttccacaggctatacaggaagcacggctgggagggcccaggaaactttcaatcatgatggaaggggaagtaggcacttcctcacatggccagaggaggagagagagtgaaggggtaagtactacacacttttaaacaaccagatctcatgagaacttactcactatcactagaacagcaagggagaaatccgctcccatgatccaatcaccttccaccaggcccctcctccaatattggggattacaattcaacatgaaatttgggtggggacaagaatccaaaccatatcactattctaagtatgtaagcagccaacaatggagcatctagattaataaaacaagtacttagaaacctctgaagagacttagataaacatacaatgataataggagacttcaataccccaatgacagtattagacagatcactgaggtagaaaactagcaaagatatttgggttctagagtcaacacttgaccaaatgcacctaacagacatctacagaacactccacacaataacaatggaaaatgcatccttctcatctgaacacagaatgtactctaagatcaaccacatgctcagctataaagcaattctcaacaaattcaaaaaaagcaaaattataccaactgccctctcagacaatagtgcaacaaaaatagaaatcaataccaagaacatctcttaaaaccataaaactatatggaaattaaacaacttgctcctgaatgacctttgaataaacaataaaatttaggcagaaataaaaaaaattatttgaaactaaggaaaacaaagatacaatatgccagaatctctgggacacagctaaagcattgttaagaggaaggttcataggactacatgcatcaatcaataagttagaaagatctcaaattaactatctagcattacaccaagaggaagtaggaaaaaaagatcaaaccaacctgaaagctagcagaagtaaagaaataaccaaattagagctgaccagaatgacattgagatgtgaaaattcacacaaaagaaaaactacggaaagcagtttggtgatttctcaaagaacttagaactaacatttgacccagaaatcccattactgggtatacacacaaagcaacataaatctttctaccaaaaagacacatgcgcacatatgttcattgcagcagtattcactacagcaaagaaatggaatcagcccagatgcccaacaccagtgcactggataaagaaaagatgatacatatacagcatggaatactatgcagccattaaagaaaaacaaaacaacattctttgcaacaacattaaagcagttggaggtcattatattaagcaaataaccacagaaacagaaaatcaaataccacatgttttcacttataagtgggagctaaacattgagttcacaaggacacaaagatgggaacaataaaaacaagggcctacttgaagggggagggaggagggcaaaggtcaaataactatctattgggtactgcactcactaccttggtgacaaggttatttgttcaccaaaccacagtgacatgcaatttacccatgtaataaacctgtacatgtatcccatgaacctaaaagttgagaatagaaaaaaacaaaaacatattaacccccaaatgatttactgtcacttaggagaggacaggggtctaggatatgatgattcaccaaaggttccatagtcaggcccggtggttcacaggtgtaaccccagcactttgggaggctgaggtgagcagatcacttgaggtcaggagttcaagaccagcctggccaatgtggtgaaaccctgtctctactgaaaatacaaaaattagctgggtatggtggtgcacgcctgtaattccagccattcaggaagatgaggcagaagaatcacttgaacccaggcaagagaggttgctgagatcatgccactgcactccagcctgggcaacagaagtgagactccatctcacttggaaccaactcaaatgcccatcaatgatagactggataaagaaaatgtggcacatatacaccatggaatactatgcggccataaaaaagaatgagttcatgtcctttgcagggacatagatgaagctggaaaccatcattctcaggaaactaacacaggaacagaaaaccaaacaccacatgttctcactcataagtgggagctgaacgatgagaatacatggacacagggaggggaacatcacacaatggggcctgtcagggggtgggaggcaagggaagggatagcattaggagaaatacctaatgtagatgagttgatggtacagcaaactaccatggcgcatgtatacctatgtaacaaatttgcatgttctgcacatgtatcccagaaattaaagtataataataaaaaaaaaaaaggttccacaaggtacaagcaagggtgatcataatggaacactttcacgttggatatccaaaggtataggaataaaaaagatttgagaatattgggaaataaaaaaaagatgatattcagaacagactaaattatctctctaatttggcataaacagtctgcaaaacaagggtgttttgttaattcacaacttgtaaaataaacaccacattattccatctaaagtgataattgatttccacagtgttaaaccaacaactttgaaaagaatttcatagtccagtctgatgccagaatccttatgcttctttctactttttgatcagtgtatattttgtaaacatacacaatgacaaatgacagcaaagatcactattttacattctcccttctactcttctacttctccatttttaatttgttctttaatatgaagttcttaaactcattatttaaagatatccaatgctatgaaaatttgatgtgtataattctccatgattatacatataaaagtatataattatatatgatttgttttatttgatttttaaataagtaatattctatacatattagtctatggcttggtttttaatgtgttatgataattcccccaagggtaagaaaatacttgtattttccaatttttgcatgcatgcatgcatatccatctgtaattataaatgaatcagtgtaaataacacatgctagattgctcttcttaatataatatgttagctgttcttttttccttcttttctcctgtttttccttttcctcctccttctcctcccctttcctctcttcctcctctgtctttatcttctttgatcagaccactcccttcttctggctaacaagtgtggaatgagaatgcttaaattcaaacatttggtcaagcagatatgttgcctagagcaagataacatttcctcacttgtaaaatgaggataagcataggccctacatttgaggttttggtattagaatatatattcatatacaaaaatgtttaatataatgcttggcacataaagagactataatcagtgtaagcagttattaactaccctgcttatctttccagccattctatttatatttttcacttgtttcgcagtgtttcagttataacagccttttctctcttccttaaataggccaaactttctcttgccttagggcttttgcactggttgtttcacccttaggtattttactatgaacttacttacgcatctttttctgcttctttttgccctctaaagtactatatataagttctataaaagttggaatctggtttgttgtgttctacactgtgtctctacagcctaatatcatgcatgacacagagtttatggtttaacatgtacttgttggatgactgtaaaattccatttgatatttagtatcagagtaacccataaagataggtattatttcctcaattttataaataataaaagtacaacaatgaggcttaatgctttattgatagttaagctgttgaattgggcttgaatgcagtttccttttctgtgtgttgtattctttccactgtttcctatgtgttatgcatttttaaaatacacagaaaattagctttatgagattgtaaatctcttcgaatcatgcattttactgtctctatgtaaaaattataagctcacaataagtacataatatgcattttttattactaatgattttcttcccttcatgggtttatgctttttctaaatgtaaaatatttgtctaatacatatatgtaaaatacatagtatgtgtaaaatatccttttctaagcttgctataaaatcttacttgtttatttaggtgttgatagttaaaattaatttggcaataggtatgcaggggatgtctctgaaacccttggaagacattgatggtttctgaacttcaactggtgtagcagattgaaggcaaatcccaggccaaatatacatatatatgtgtgtgtgtgtgtgtgtgtgtgtgtgtgtgtgtgtgtgattatatatatttatatataatatataaaatattatataatatatacatgttttatattatatatatataaggcataagacaacacagagagaatatgtttaatacgacagcaatttagaagtaggaaacagtcattgcttgtgaaataagggaggctatggtagttgctgtgctgagcaataatgaccaagtgaacataagtgggatattgcagccagaaataggaacaaaaacagaatagatagaatatttaaaaaaaaaacttgaaagctactgcttagaatgggcttgactcacatagctgtactgaggtgaaactaaaccaagagatctttggaaattttctcccgagacatacaagaatttacctagcaatatacagtatgcaccctttaaatcatcaggctggcaaaatcatggtttgtgtaatacttgacattgaaagttaaccccttcttttatttataattagagacaaatgaagaactatgtagaatgtgaggcaacaagaggtgtttagattgttctttcaacacttaaagacctggaatgtctggtcctttttctccacttttactgtaataaaggcagtccaaattctcatcatttaacccctgaatgaaaacaggatcccaacaacttgttcccctgatgcctgaggccaatgcacagtgtccggaattttcctcttaaatgtgaactgaccgtggtggtccaatcctaaaatctcacttcaggctcctagtgaagaactgttagttcttagctaacatcacgtttctcttggacagctcacatattcatagttgtcttctaatcttaaaatacacataaattcactcagcaagcttgtaaaaatgtacatatttggacctcaaattcaaagattctaattccatatttcttggatgtgacttggcaatttacttctaaacacatgctccagcaagtgaaataaatgactatataggcatgaagaactacttagatgccctaaacaccctgctattttacaactatttgccaagaacatcttccctgccaacttggtctttttgtcttggaaaattgctacaaattcctcacaaccctgttcaggtattgttcaggtactgatcacttctccaagctttccattattcctccttccctccactagatggttaatagattccttctctatatcaattctgtgccttgcagatacttattttactgcctattttatattttggctttattgtcatcttcacaaataaagcgtaacctcttgaagggttgaaaattacttttggtattagtggttagcaaactacttggcacatgttaatgaagaattaataattgctgaatttagcatttttacactgaccctaagagtaaggaccaagttctggttctatcacttttgttcagctaattatatgtagagatacagatatacatatacatatatacatatataaatttgaacacagggttctcctaacacacatcttaataggtacagaggagaaagatcttggatgtttgaaaaggtagagttgccattttctctctgtactctctctgtacatgatttttggattgagaatatatctagaatgtcaccaacaataaataaactatgctgggaaaatcatttataatagacagatttataatgtcaattattaacatactgcagactttttcaaataggggagttcacttggaaatttaaaaaatgccagctggtcggttctgagatcacagaaatgaagattcctttgcaataaaaagaatcactttgtttttttgtttttttcctaaatctccacttctgcttatagtgactgtacccaaatcaaggagttataaatattaatctggtaacttcaaattgagaattcatagccactaaaatgggttgccttaagaaaaatcttttttccatcatccaaggtcatatgcctcttatcaaaggaactacacatatattacaaagttattttcagtttttctcatgaatttctatgtatacacaggtctctgtatgtagctaataacatacttagggcaaaatgaaagaaaggaaggcaatatttcccatgctcctaagttaaaaaccctatttgtctgtgtgtaatatggaaatatttacatattatctgtacagatttgatcatatgccaaaacatgtcccccttcaagttctatctgctttggacatccaaatacaattcaaataactttcaacagttttacatgtaatgaattctcagcaaattaacacaagaaaataaaaccaaacaccgcatgttctcactcataagtgggagttgaacaatgagaacacatggaaacagggaggggaacatcacacactggggcctgtcggggggtcgggggctagggaagggataccgttaggagaaatacctaatgtagatgacgggtcgatgggagcagcaaaccaccatagcacgtgtatacctgtgcaacaaaactgcacgttctgcacgtgtaccccagaacttaaagtataataatgaaaaaaagaccaaagacgttttgtgtgtttaaattattcttaaagctgtataaaattagcttgtgaaagttgatctaactaagatacaacaaataaaatgatcagtgatatggtagatctctcttcctatagagtagcgatattatttaacatgatcattgtttagttataacaattacttaaaaagaaaattttgactcccatttggtataatttttctggaattcggtattaaagtgtaactcatattgttagatatttttcaccttgcattgtccatcacagtatctactgtatcaaatgcacagttcatgaatcagatcagctcttttatatatctgatatatcatagtttattaaacttgaaatttttgcgtggaaaatatcacatctgagccacttggaactttggagtatagtgaaactccaacacactgattttttttctcaatccaaataaagcatattggaaatatgtatacttgcttaaaaatcgtttctatatagtcagtatttaggtggataattcaaaagtactctacctaatataatgtgaatactaaggactaaaaaatatgattaaatttggaatctcaattttagagtttttgagatgagtttttttttgagaaattaacattaaatcattttcatgttttataaaaatggaacaaagtattctaaaatgtaaagaatgcttgtcctaatacctagtaagtaatccttaacatagagcttgaatcatgtaataaattgccattgttctgccctaaattttcaatgttaaaggttaacacttttgggtctaatagaataacaaagcagaaggactcctaagacattcttcagttgactaaactgtgagttggtactgaattgcctacaaaaactggactgaaaaaacagtgtttgcatttcagtaaggtgaatgtaagaaagccaattattaactcattagtattccgcagctttactttcaaagggtaggagacaaaaaaatgaaagaagaatgtatatataattttctgtgtttattctattgactgtgtgaaggtaccaggacagaataacatttggaaaaaaacaaatatgtattcataaattcaggagacagattctttttatgggcaaaacatgatttttttttgatcaactgattcaaaaaaataataatatgcaaagcaatggttatttccatataaccttaggctttttcttaataacaacacaattctaatttttgcctttaggattcctttaataattacatggctaataaactattgcttttcctcatgcatatataaatactgacttgttccttatgagaacattccagggtattattagaagcatttgtcttgcactttactctacgcaagcactttaatgatctcacattgtttggaaatcccaatgagcttttgaggtaagtctcctagccttatcattttacagattttcatttaaataataataatacttttattcctgcatagagtattatgtaatatatttaatacatatataatttatacaaaaatatacatgctatatatatatatgcacatctcatatgcatgctttttaatgcctttacattttttccttagtgttttattttataatcagtgctttataaaaggatgcattccttttgaaaactatgcttccttcagctactaggaacacagtatggtatatggaaagaaaaaatgaaaacctctgacaacacttgcagctaatatttattagattctttttgcttcataaagtgcataacaaatttgcatgcattttactcatatgatctctcacatcaagcggtaatggtggatatgtttgttattgctcctatttaacagatgagagtactgaaatataaaaaggtaagtaagtttcccaagcaactaagcaagtataagtcaagatctgaaacataacaatgtgtctgtggaatctgatttttaaatactgttaatcactttaacagcactaatttggcaataacttatttcaaaagctgcttcctttctctaagcctcaatttcttcatattaaaatttcagtatgaatattgcaacttttaggatactcatagcacaaatattatgtttaaattagtgattatcttagtactgagagtaatggtgccaataataatagtttccatttactaagtctctactgtataccagaagcactgtgaacattacttcctctaacctgcataacacatccccaagacgaacatttcacattttatagttagaaaaattaagaatcagagaaattaattttcccaagatcatgtaactaggacatagagtatctggagttaacatcctactgtatgtgactcaaagatatttattttcttatcaccaaacattgtaagtaatttttactgtattttacacatcaaaaaccttagccagcacactatcatacatttactgaaacagagtagatatccttatctttcacttagaggcattgcagcatggttaagggcaatgctcttgaagtcaatatagtaccatggaattaaaaacaagaaaaaaactgggcaagcctcagtcatactctactacagatgctctttgacttatgatgagattatattcaataaacccatcataagttaaaataccctaagcctaagatggatttcatctacccaacctactaaatgtcatagcataacatagcctaccttaaatgtgctcagaccacttatattggtctacatttgggcaaaatcaaatgcttatttcataattaagtgttgaatatctgatgtgattcattgaatatggcactgaagtgaaaaacagaatggttataggggtgttcatcatttatgtacataactgaaagcacagtggacataaagagtgtttgaagcattgaactaaaattaatcgccggatgatggagatgctacagcaacagagtcaccaatttctccttcttctgatgaggttcaaaaatagctggtacaggttgagtaacccttacctgaaatgcttgggaaaagaagtgtttcagatttcagatttttttgaatattggaatatttgtattacataatgagatatcatggaaaggggacccatgtcaaaatgcaaaagtcatttacatttcacgtatacacacatagcctaaaggtaattttaaatgatattttaaataattttgtgatatttttacatgaggtcgtatgttgaattttcttcctgtgacatcatgttggtgctcaaaaattttcagattttagagaatttcagatttcaaattttcagattagggatgttccacctgtagaagaaactggttattgacacttattgatggtctagagtttgatatggtttctctgtgtccccaccgaaacctcatcttgaattgtagctcccataatttccacgtgttgtgggagggacccagtgggagataattgaatcatgggggtggtttcccccatactgttctcgtggtagtgaataagtctcttgagatctgatggttttataagggtttcccctttcacttggctctcattttctctcttgtctgccaccatgaaagatgtgctttttgtcttccaccatgattgtgaggcctccccagctatgtggatctgtgagtccattaaacctctttttctgaattcacagtgttctttggaaagatagcaagtattgattgtacagcttatttcttattattacatatctttctgtaacaagcaagagcactgtgtctctgcctgtcagttctcatgagtctctcctaatcgacgtgccatttctttaacatctgtatgccactgctgaatgcagcaaaggcctccacaggtttctttgctgtacactttcttggttcctccggtttaacttcttcctctgcctcaacttctttacttctttcttcctacagtttgatcacttgaaaactcagtgccaacaaacccatgaatatcctcttcatcaatacccaattttagctgtttctcaagtgctaataacttgttacctactattcatcaacagcagagtctttgttaaagcttttgaatgtgttcacatatgtcttcgaaactttcttccacatgccgatcatgcactgctgtgtgacttcttcccatgctgttgcgatgttctggatggcacttaggatgtaaaaacttttccaaaactcttggagaagtcagccagactcagtcacttcactaatctacacaaatccttggcataaatatactttgaagggagctattgctccttgttccattggttgaatgaatgtggttttgttcagtttcaaatacacagtcaaaaaaattgcttttatttctgtttgtttattcacttttcctgattgtctttatgcagagccctaaagaagttagtggtaaagccaaacccttgacatcagcagaactttgagcagcatatttggttcttcatttctcctgaaaagagtgatagccaaagaacatatctaccctgatgccctgggaaaagttaatagtttggctgacagtacttgaacataattggagcatcggtgacagggaggactgaagaagatttatgtgattaattctctctacttgggtacagagcttaaacacatttgtgtcacatataggtgctaaccaaagagtaacttcagcagatggataagtgaaaccatttgtaggagatcaagtgggtccccttagtactcccttgtgttgtgatcaaagttattggaaaactacaatggactaacacaggaagaactactaatggccaaggctcttcaggaacaaaatttcaggtcattgtttcagacaaaaggacctgatgatctggttaaaataaaagtaataatgaaataggtagtacaagaaggaagctataaacaagctatgaccatgtgaccaattgcaaacataagaattgcgataattatgaaaagttctttcttattttggtgtgaatgtatttcaaaaagattaaccaaagtttcccttttttccacgtctcctgccatctaacataaaaatgtgataatagtaattaactttatgtcaccgtatttaactcatatgatactaaagagggagaagtgtatcagaagtggaatgaacatcgaccactggtgaacaaatgacttttgtgagtttgtatccactttcagagtgatggttagcgtgctttcagttggtagaagtatagatgcgtcaccttggaaagaagcatgattttaccgttacctttatttggaatgtaaacgtgatttaaaatggaatacattgatgtcaatttgagaggtaaactttagtgaaaccatatttttaagaataatttttttcctgttaaaattgctgcagcacccattgtacctcgtgtgggtaccctgttctgctcttgcatgctgttgctgatctgctgactttccttgtcagtatgaagtagttagtagcatacaggttaaaggtggtaacagatatgggttacaattattgtccccatggactctaatttggcttcatggatatcagtttgccctcactctcctctgattcacactaacttttccttcccagctgccagcctaggtgacctgcagattcttcacgcctaccaccagaaacagagagaatagcacttcacagattgctacaacagatcccagttttatagagtttattttttacagaaaatcttgattcatattgattattgtgttgtttgtttccatattaagtctcaactgatgtcttcagtttatgtgatatatcatacggtcactttatggataatgcatttgggtgatcacattaaatttggaaaatagtctttgaactcctggaattttaactcttagtctcaaaccaaacacatatctagtctaactttctaaaatatgactgaaatagatttatatagctactatatttttagtttcaaattttctctatacatttttaatagcattgtttaatacaagtccctggatatgttttctatgacctcaaaatgttttgaaattttgggtcaaataaggtatgtgagtgcttatttttttttctttgggggagtgttttcaaatgaactttgaagcccagttggacactaaccaaacatttaagaaaacataccataacccttgattttataaaagaactaatacctgctaatccagctcaataatgaaaacccagagatttcatctttcaaattccaagttgacatttggtgttgttatttataatgtcaaaagccagcaatttatttcttaagagaaaattcaaaacaccccttctagggttcttgacctccggatatctttctgtccaccaagatgtctaataaaacataaagtttccatgatataaatttaatatggattactgaaatttgagtaagagttcttattaaatttaaaagtacagagtattctttcttcactagtgtagatgcaggtatggtttcaggaaacctatcatagcttgaatattttaaaactctattgatttttgaacatggtatagacatttctggcattgtgtgtgtgtgtgtgtgtgtgtgtgtgtgtgtgtgtgtgtgtattattgggggatgatgcgtatatgtctaccaattaactgtacatacaataatatcttgctatcctacaaaaatggcattacatttcattttaattttttaatgaagaaagggttatcaaaatttagttactacttctgaaaatttaatcttaattttaaactagaaatgtcaaatggcaaatgggttttttcctcatttcatgaactgcaaactcacataacatattgatgtttgttaaatcatttgcagtttcttagaggttttaaataaaaatatttactcatgcagaatagttattttttaaaattactaacacgtagaatagacagcaaattattaatgaaagtataatttgactttccattattttctttaattcaaaatattatattctgtctaattatactctttaaaaatgtcatttcatgatgcacgtgtctactttatctaacttcccttaaagcctaaaagacctaagtgaagattttaccatcaaaagttaaaaactaaagcgagccattttccaagaattagacagtatttttacacagccattaaatcataccacatgacaaggctgataaacttcatctgtcatatgaaattatctaatacccctaaaataaaatataattttataaatttacctggttatctgaataatcagatttttcattttatgaaatattcttaaatgtacaaaacattttaaaaatatgaatacataaaatatgtatattttatactttaatttgtgatagtatgggttttaaaatattttagtgttagatttctttttctttgatttggccaaatattccatttcatttatttttgtttatttatttatttatttatttatttatttatttatgagacacagtctcactctgtcacctgggctggagtgcagtggtgcaatctcggctcactgcaaactctgcctcctgggtttaagtgattctcatgcctcggcctcccaagtagctgagattacaggtgcacgcccccatgcctggctaaaataatattcagtctaattttatatgtctacacacaaacacaccagtattccctcacattagaatattgttatattattttctattatttcaaaaacatcttattgaacacaaaacaaaatttttgtcatcattgtagacatgacaatgcaagcaaaaacatacttgaaattaaaaagaatcacactatgtatttttatacatgcaaggtgaattttgattaaagattaattatgttaaaaaatcttaatcatattaatactccaaactatcctaaataggcaggtaagtctcatttaagtctgatgcagctgttatttgtgaaactcatgttaatgttaatggttcactttctcaaaaaacagtatttgaaatgcctactatgtacctggagaaattcttggattacagcaatgaatcaaaaaagatagtctttgccctcacagaaattgcatgtaatataatgatccaaatattctctattctgagataaaaggtgctgacagttgtttgcagaaaaatattagccacaggcttgcatgtttaccttccatctgtcttctccctagagcatggcttcgtattcacaggcttacaaaattctgtctttttatatagggaattcttcttgttttctaaccactttgttaacatgaaaacaattatgtgctttactcatgtaataagatttacagaggatatttcttttacatattgttaaaatgttagtgctatctctgaacaactatatcacagaatgaagaaggcacatctttgtgtagtcttaattttaactaatagtcaataattgaaaaacccagaaataaattaatctctgattccttctaaagaaaacatatatataattataataatgttcacacagcttcctatcagtgttttacttgccaacaataataaagactttatacaaaatagtgatttttaatcagataaatatataaagttagcaatttaggattatgtgaaaggataataattatctgttaattttaaattgctggtattttagtcaactgaaaatctatcatgaatattagctgatttacctctcctgaaaaaaaaaatgaaagcaaggagtagcacacagttagtttttttaaaaaagtatgaacaagtatgaataaaaattatattttgtgagatttagctggaattttgaaattggctgaaataaaattgaaataattgcttttctcctgggattcaaaatagacttcaaaaaaaaaaaaaaaacagttttaactgaaacaaatctattcattgtgaaacattatttcaaatccatcagggtccaaggtgttaaaagaatattcaaataatacaaataaaacatttacttagcaaaactttcatacttgctatgcaatacagaatggaaattctaatagaggtatcaatggttcatcagtaacagaaaaacaaagaaaacatttgttataatagtgttccataaaacttactcatcgaaaagaaattttagactgattgtttctaagatttggtaaagtctcaagtgtagcatgaaaattaatcacttgggggatggagccaagatggccgagtaggaatagctctggtttacagttcccagcgtgagtgacgcagaagacaggtgatttctgcatttccatctgaggtaccgggttcatctcactagggagtgccagacagtgggtgcaggacagtgggtgcagcgcaccgtgcaccagccaaagcagggagaggcattgcttcactcaggaaactcaaggggtcagggaattccctttcctagtcaaagaaaggggtgacagatggcacctggaaaatcgggtcactcccaccttaatactgcacttttccaacgggcttaaaaaacggcacaccaggagattatatcccgcacatggctcggagggtcctatgcccatggagtctcgctgattgctagcacagcagtctgagatcaaactgtaaggcggcagacaggctgggggaggggcgctggccattgccgagttagttgtttgattaggtaaacaaagcagccaggaaactggaactcggtggagcccaccacagctcaaggaggcctgcggcctctgtaggctccacctctgggggcagggcacagacaaacaaaaagacagcagtaacctctgcagacttaaacgtccttgtctgacacctttgaagagagtagtggttctcccagcacgcagctggagatctgagaatgggcagactgcctccttaagtgggtccctgacctgcgagcagcctaactgggaggcatcccccagtaggggcagactgacacctcacacggtcgggtactcctctgagacaaaacttccagaggacccatcaggcagcagcatttgcagttcatgaaaatctgctgttctacagccaccgctgttctgcagccactgctgctgatacccaggcaaacagggtctggaggggacctctagcaaactccaacagacctgcagctgagggtcctaactgttagaaggaaaactaacaaacagaaaggacatccacaccaaaaatccatccgtacatcaccatcatcaaagaccaaaagcagacaaaaccacaaagatggggaaaaaacagagcagaaaaactggaaactctaaaaagcagagcgcctctcctcctccaaaggaatgcagttcctcaccagcaacggaacaaagctggatggagaatgctttgacgagctgagagaagaaggcttcagatgatcaaactactctgagctgacggagaatgactttgacgagttgagagaagaaggcttcagatgatcaactacgctgagctacaggaggaaattcaaaccaatggcaaacaagttaaaaactttgaaaaaaaaaattagatgaatgtataactagaataacaaatgcagagaagtgcttaaaggagctgatggagctgaaagccaaggctcgagaactacgtgaagaatgcagaagcctcaggagccgatgagatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgactggtgtacctgaaagtgacggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaagattgggttacccacaaagggaagctcatcagagtaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccccaaaagagctcctgaaggaagcactaaacatggaaaggaacaacaggtaccagccactgcaaaaacaggccaaattgtaaagacgatcaaggctaggaagaaactgcatgaactaacgagcaaaataaccagctaacatcataatgacatgatcaaattcacacataacaatattaactttaaatataaatgggctaaatgctccaattaaaagacacagactggcaaattggataaagagtcaagacccatcagtgtgctatattcaggaaacccatctcatgtgcagagacacacataggctcaaaataaagggatggaggaagatctaccaagcaaaaggaaaacaaaaaacggcaggagttgcaatcctagtctctgataaaacagactttaaaccaacaaacatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcatctctgcaccaagaggacctaatagacatctacagaactcttcaccccaaatcaacagaatatacatttttttcagcaccacaccacacctattccaaaattgaccacatagttggaagtaaagcactccccagcagatgtaaaagaacagaaattataacaaattgtctctcagaccacagtgcaatcaaactagaactcaagattaagaaactcactcaaaaccactcgactacatggaaactgaacaacctgctcctgaatgactactgggtacataatgaaatgaaggcagaaataaagatgttctttcaaaacaacgagaacaaagacgcaatataccagaatctctgggacacattcaaagcagtgtgtagagggaaatttatagcaccaaatgcccaaaagagaaagcaggaaagatccaaaattgacaccctaacatcacaattaaaagaactagaaaagcaagagcaaacacattcaaaagctagcagaaggcaagaaataactaaaatcagtgcagaactgaaggaaatagagacacaaaaaacccttcaaaaaattgatgaatccaagagctggttttttgaaaagatcaacaaaattgatagaccgctagcaagactaataaagaaaaaaagagagaagaatcaaatagacgcaataaaaatgataaaggggatatcaccaccgatcccacagaaatacaaactaccatcagagaatactacaaacacctctacgcaaataaactggaaaatctagaagaaatggataaattcctcaacacatacacccccccaagactaaaccaggaagaagttgaatctctgaatagaccaataacaggagctgaaattgtggcaataatcaatagcttaccaaccaaaaagagtccaggacaagacggattcacagccgaattctaccagaggtacaaggaggagctggtaccattccttctgaaattattccaatcaatagaaaaagagggaatcctccctaactcattttatgaggccagcatcatcctgataccaaagcctggcagagacgcaaccaaaaaagagaattttagaccaatatccttgatgaacattgatgcagaaatcctcaataaaatactggcaaaccaaatccagcagcacatcaaaaagcttatgcaccatgatcaagtgggcttcatccctgggatgcaaggctggttcaatatatgcaaatcaataaatgtaatccagcatataaacagatccaaagacaaaaatcacatgattatctcaatagatgcagaaaaggcctttgacaaaattcaacaatccttcatgctaaaaactctcaataaattaggtattgatgggacttatctcaaaataataagcgctatctatgacaaacccacagccaacatcatactgaatgggcaaaaactggaagcattccctttgaaaactggcacaagacagggatgccctctctcaccactcctattcaacatagtgttggaagttctggccagggcaatgaggcaggagaagaaaacaaagggtattcaattaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatctgacttacaagggacgtgaaggacctcttcaaggagaactacaaaccactgctcaatgaaataaaagaggatacaaacaaatggaagaacattccatgctcatggataggaagaatcaatattgtgaaaatggccatactgcccaaggtaatttatagattcaatgccatccccatcaagctatcaaggactttcttcacagaattggaaaaacctcctttaaagttcatatggaaccaaaaaagagcccgcatcaccaagtcaatcctaagccaaaacaacaaagctggaggcatcacgctacctgacttcaaactatgctgcaaggctacagtaaccaaaacagcatagtactggtaccaaaacagagatatagatcaatggaacagaacagagccctcagaaataaggccgcatatctacaactatctgatctttgacaaacctgacaaaaacaagtaatggggaaaggattccctatttaataaatggtgctggtacaactggctagccatatgtagaaagctgaaactggatcccttccttacaccttatacaaaaattaattcaagatggattaaagacttatatgttacacttaaagccataaaaaccctagaagaaaacctaggcaataccattcaggacatagtcatgggcaaggactttatgtctaaaacaccaaaagcaatggcaacaaaagccaaaattgacaaataggatctaattaaactaaagagcttctgcaaagcaaaagaaactaccatcagagtgaccaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatataaacagacacttctcaaaagaagacatttatgcagccaaaaaacacatgaaaaaatgctcatcatcactggccatcagagaaatgcaaatcaaaaccacaatgagataccatctcacaccagttagaatagcaatcattaaaaagtcaggaaacaacaggtgctggagaggatgtggagaaacaggaacacttttacactgttggtgggactgtcaactagttcaaccattgtggaagtcagtgtggcgattcctcagggatctagaactagatataccatttgacccagccatcccattactggatatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaacgaaaacatcattctcagcaaactatcgcaaggacaaaaaaacaaacaccgcatgttctcactcataggtgggaattgaacaatgagaacacatggacacaggaaggggaacatcacattctggggactgttgtggggtggggggaggggggagggatagtattaggagatatacctaatgctaaatgatgagttaatgggtgcagtacaccaacatggcacatgtatacatatgtaacaaacctgcacattgtgcacatgtaccctaaaacttaaagcataataataataaaacaaaatagaaaattaatcacttactgtttttaagtcatttataatatttactctgactgttgtcaataagatccctcatatctctaaataaacccttttaaagatactgaataaactccttagagaatactgatgggatgctatttgctattttctcacaaataatgctcactccttgcctgtcccgaagtattaagataaaaccaagcacattaatcaattttcaccaaaatatattcaataaagaagatcattttatcaagcaaagtaaatatatttgtaaggatttatctgaaatgtgaagctgctactattgaatcttccctctttattaatgattttttaaaagagaatgtaatataacaaaaatcacttattaattttgatggtaccacactatgaaattttctgacactaagtattactttccaatagaaatcatcacattcatattgacctttggtatgactgtaataatcctctactttgtgttaaatgaggcagtgataccactgagccaaattgaatgacttaatgcattttctgattttttctgagtaaaatatatttttaaataataaagttggccgggcgtggtggctcatgcctgtaatcccagcactttgggaggccgaggcgggtggatcacgaggtcaggagatcgagaccaccctggctaacacggtggaaccccatctctactaaagtacaaaaaattagccaggcatggtggtgggtgcatgtggtcctagctactcgggaggctgaggcaggagaatggcgtgaacctgggaggctgagcttgcagtgagccaagatcacgccgctgcattccagcctgagtgacagagtgagaatccatctcaaaaaaaaaaaaaaaaaaaaaaaggaataaaattatctgtgattgtgaacaaacatctacacacagttgtgaatttgaatttttaattatgcgctgctatgacattgagtgatgaaaaaagaattattctttgtaaattatatgttactagatgaggtcaccatcaactgatttgttggcaaatcaattaaaaagtcaaaaacatttttgactaatctacatacattcaatcaacatccatcttctctatttcaatcacatatgctctttctcatcttctccagctatcttcttgccatttcttaaacttatcagcatattcatcttcagagtctttgaatttattcctctgtctataatgtaaattccctggatgaatgcatggctcacatcttcagtcttaactttatgcagttttgctctaatgtaatttcctcaaagaaacaagtcgtctatctgaaacagcatcactgcctcctcagttgttaatcacaccttggtttcttgctctgtttcgtttttactccctgtctctatctccatgtggaaagtggttttgcctgttttcttctctgatgcatcgccagtaccagaacagattctcacacaatatagagtgtcaataatcataccttgaagaaataactaagcaaacaaatgattaatgaaatgactgattgaacaacaaaattatgtattgggcatgtgttcaagattgtttgtaacagggaaggagagaattgcaagcaggtggtctttacttacattctatttcagctgttttgttgtaaaaatgaagacaaatttgggagaataattttaatactaaactttgactaggaactattgtctttcttactcaaaaccaacttaagaagcaacactctcaaccacacccaggtctgacaactcaaagcactgctctgtaaaattgtaaattttcaaaagcaaacacacaaatgacagtaaaagcaatatcatagtttccaatgtgtcctgaggtacatgaaaagagcttagtgctaaccaggtcagcatttttggaatgagaaccaaggattactgtatgacaaaatggagaatctagaaagcaaaaacttggatcaataataaacaaaatcttgattcttgacatcaatggcaagttgctttggtggattttttaaaaaagcactcaatatattagtatatatctacattttgttgaataaacccatttgaatttaaccaaaagtagtgtactttaacagtgcgtagattataacaatttcataaaaattttatattgagtatacttaacagattcatttctattcatactgaaaagtaattatacattctttgcttaaactacactacctgatataaatataaaataaatgctcattttagtatatatgtcaaatttgtatgaagtagtcatagatgaagggatagcaagtactttcatgttctttaaatcacatgacatacttacatttagttgaattacataagtaattcaatttaggaatacttggcatttgaatatttgttttgaaaactgctgtaggaaatattttaagtccaaaatattttcaagatagtttttgaattactatttatatctagcaattgctaagaaactttatactgttgattactgcactctattcaaaagtgaaggtagtgatcagattttcagtgtcttaacagggaagaaactcacagtccaattgtctcagcaacacaaatccgaagtctaacagtcaatatttgatcataaggaatggaagaaatgaaataactgtttacggcaaaaggaaatttagagaagaaaggccttaaagacagggaatggtaaaatctaagacctcaagagagcccgtgtaaggaagagaggatggagaaatactgcttaggaaagttctgtacaaagaaaatcttcatgacctttatttcaaagccagtaattgaactttggtgcttcctcccctcttacatcgataaatttccacaagcaactcactccccaaataacttttaaaaaattatacaatctaaatgtaaacttcttcattgagtccatcatggcatccttggttgatgttgctttcaaattatggagacaactcagatttacctttcatttcccaaatttactgagagtgtacaatatattttaaactttaaattcatgaagctccttcagggtgggttttctaatctctcacgtagtgatatccttttgtctctgcatctgtccatttctgtacagtcacagtggtgtgttccaaccatgacttaaaatcattttctccttctctttacgtagcagtgcctgtacacttcggcagattctgagaattagtttgaatgagtggttccaaagtatgtttaatgtcaatctatagttgctgtaaagcagccaaggactctgatgtggctggcactcagtggcaggtctttaagtagtcccagagtaactgtccccacctctcttctttcagtaaggcttcaatgctataagcaacttagagtcaagagaaactagaaaatatctgttcagaaaggtattttagacattctcacttaattaaacatagataatgtgatctgtttctctaaatccattctcccctcaaaatgaaattacatactaaatacgctctacatgctagttcaagagctttctggtggtagtcaggaactaacatatctctttgtgtgtccactttgcccctttacaacgtaagcttagtattaccagcaattgtgatgaaaataatctcttgttcagcccaagatgatgtaatgaatctgtcattaaggtgctgttgaggacaaagatcaggaattgaaagcatctaacagagcccaggatgagaaagaagtttatggatctctgcctgttaaattcataattcttccaagcatgcacatatgtataaatgcacttgacatatatattcacaaagaatatttctgtcccacaaattataaaagtctttgagagatagagacatgtgtataaataagtgttctataaatgtagctcaatgacttacataaacaattagctataatttaaaaaatgagctatttagatgctttgctttagtagtgaatgtatttagatatagagattatttagcaatagacatcagttaagtgagccacaggcaatttgacttcaagtaaatttactaatttagctgattaaagatttgttaggcctttcttttcaaagaagcttcaaagcctttaaaaatgagtgctcatcattctggtaaaataggaaacccacatgttttattactaccaattaaaagatactggaaaggagaaattaagagagtatagagcaaggctaaaaataagtatttcttttctttctttttttcagacaggatctcactctgccacccatgcttcagtgcagtggaatgatctcagcttactacaacctcccctcctggcctcccaggttcaagtgattctcgtgcctcagcctcccaagtagctgggactgtgagtgtgtgccaccacacctggctaatttttgcatttttagtagaaacagggtcttgccatgttggccaggctggccttgaactcccgagctctagcaatccagctgcctcagcctcccaaaatgctgggactacaggcatgagccacccaacatggccaaaaataattgtgtcattgggaagttttgattgcctaaagaaaaatataaaaacatttgcatggattgtttcccttagatttttaagacaaaaatgattaaagcactacattataatatctggcagaggttcatttgatcaccatatttttagaaatttaatgcaaaagagaaatgcaaaacatttactctctagatcagtatttatacttcttgtgatgacttaaataactctggcagctttctgagtagttggcagtttctacaaaatatgccaagtaaggagcacaacattagtatactatatcatgtcattttcttctaaaacacaaatattgaacttttaccacctgctactgtacagcagtgctatggcaacatcttcgtagagttcctaagctcctttgaaaagtaggatctaatcagcacaaaaggaaataaactatcatcattgctgttgctataattacctagttggcaaaataagctctatctatacagaatcacacattaaaacaaatttgcttaggaaaactaaatgttttatttcagcccagcttacattttcaaatgaattggttaacaattagaaaagaaattgttgataaaccttgcattatgtttattgaatttttatttctggttaaaaaggttaactgttttcactgtggaatatttagaaaatatagatttctttctttaaaaatagttagccataaggaagccataattcatcactgtaacagagaatcttttttcatatatcttttactttatagtattttaatattttttctctactgtagacacatttgggatttatttccaacttacataaatgcatcataataactgtaactccatatgattttattatgaataaggatagattttaaaaacataatcaaaatgttcacatttttgtaattacttaatgtggcaaatattttattaatacttaaatttgtttaatcagaggccagcagtactgtagatatttctgagtgatttcacagaatgtgtgggaatatacatctgcgtcaattctttaaatgagtaaaaggagcatctgtaatgcagcaaaatcaatcatgaagaagtaactgatgcaggaattgcctatacaggtttccaaagtacatgtacgcgtgtagattgagttacaagaaaaaggtcactttctaataaggcaactgacaattattttgtaaaaaatatgaaagtgcaagcacatactttagaacaaatattaggtacaagcttaatggaagagtctatcatgtaattagcagacaaaatgagccacagaccacatttacatacttagtttaaaatagaaacagagtcccaagagataaccattttactgctgcccagttgaggagaaaacactttcaatatttctacattaacgttcagagagtcaaggtggccgatgcagaacaaaaacactaatgataaggaaaaaaagtttttccaaagaagaacttggtatgaattagatattaattgttaattacttcagaaggcccaagtgaaaattcagacttctttctctgctcttggccttatttcatgttcccgctttctaagcacattaggttttcctattaatcagtcacaatcaccatgtctaatcggctgtggatctagatccttaccagatcccagccaatagaagttagcaatgtaaggcttattttgtggaccacttctttggaggaatacgttgtgtttctgttagatgactatacacatgatagtcaacttccagcccatatctggatgcattcttgagatgactctgaatcaaataatttcttttaaaccaaaactaaatatttatattaattgaatgagacttttataaattattccaagtaaagcatgaatttccagagactggcataatttaaacccatactggaggggaattatccatggatttgggttgaaactttcattttagtacctctactcatagtagattgagaattaaaatctgaagaaaaccctcttagataagacatttgtaaaataaaaaactcacttaccattccgactttcttcatcaatagcaactatggtagctggtggtcctcccctagctagtttgcaatctaaagagagaaaataaccaaaagtaataattgactgcaggggcacacacaatgagaaaaaaattcattgagatgtatattaatatttaaaaaggaaaatcttgcaatctaattaatatgcatcactacaattaatattatttaaaaacattttataataaccacatagattccttaccacatcataatacagtcactttgtgcatcacaaaactactcaaatcttactgagaaaacaccagcagggaccactggagagcagaagtccttcaggacagagataatgggatggaaatttaacccaaagaaataacagaaagggatgattaacaaggataaattgtaattaaagcatcacaacagaaacaaacataattggactttaattgtgataaagggtctaattagagagagtgaatagaattttaataatgttctaaagagaataaaacaaagacagacaagcaatgctcatgaggttgtttggggtttttatttttgtcatcttaccctcatattgccagtctggagtcaaaagtatagagtcatcaatggaagcagatcagaaaaatggaagaaagaaaggaagagagaatatatgtatatatttagtgagagatttaaggatataaaaagcattatacaataacattatctaatgatttgtggaaatagaatatataaaatccctatcagatttcctacttctaatataatgttaacacattcactggataatacacatcattagcattttaaaagccgttacaaaaaagactagaaaataacataaagtaaattggtatttttcttacgaaaaggtaaatacgaattacttatgaacagtctgttatctgtatgctgaaaaaactttaagaatagtgcctgtcaatcagtagtgatgattaattcattatttcaaacactgctaatatccttccaggtatcacatgataatgaacataaaaaatagtatgagctataatatccatgacagttgaaatgtgaaaactttgcctgcaggatgtcaaatgtgcacctctgagacataaagtactctactaggaaatactttgtgaggcagagagggctatgtcatgcagttatacatacatggcacactcctgtacagcagtgcaaattaattttgcttgaagttttccaaatttgtgtgttatttgggaaataatttcaaggtttatttacttattaaaattctgccatttattatgtacatatacatgaataattaggccttcaggaagcactattctgtattgtaaggtatgtacgctctcatatgaagcaaagaagctgggagatctacacattttctctctttacacttgtcaatattgaaggagttccaagtcataacattttcagatctaaaatatctcacactcattacgcctcttcctctccttatgccctcctacagagcccagcactacactatttgtcatctctgctcttgatttagtttcctcgctgatctcccagaagtcttgttctcatcctgcattcatctattcctttcatgagaatgattttcatgtacccaaatcaaaagtgaaataatagcattcctctgaacaaaaaccttacatgtttcttttggagaaaatgaaaaaaaaatcagaagaacaaagtttcttcacatggccttaacatcctttattgagaattaagcaacctgtccttcaattacatgaatcctcttactgttgctggaatgtagcctgtatttttagcaaaattttgttatctaaattcattgttgcctttttttgcctagcaaatctctgcttctttttgtagaattagatatttcacatatttgcacctagtgcgaattaattttgattaaagccttccaaattttcatgttacttgaaaaatgatttcaacatttctttatttatttactgttttataaaattcctccaattattatgtacatagaaatgaataattaggctttggaaagcactgtattgtaaggtatgcactctctcatatgtacacacacacacatatacacacactcatgtcactgtgtgccaatgccataatacctactgaaaatagataaaaattatgtattttagtgtgaatgttggtagaggaataaatatttaatcaacaactttatgggcaagcagaatatagaataataaaagaaggggaaatttggatataaatatttttgaacctttttacagtttgttactattaagtttaaaagtaggctttatgaagctaagccaaataatatcttcatattccagcccttcctcactctccgcctttcccattctcaaagttaattctccattcataccaaaccaaatttatgttttttgcatcaactgttaaaatatactttccactcttcttcccctggttaattttattcctttttcaggaatctgcctacgcatcacctcttcttgaaaatccttctcgttgtcattctagattaagtccttattctctgtattcctgcagtacacactgtatcccattggactaattgccccattggcacaatactaatgtgtctttctctctcacaagagcttcttcagaccatgcctgcatcattttcaccttggtaacctcagaacatgatactggtcctgaaagaatgtttgttgactttttccacaatgtagtctgctaagctacaatcttccattaaaacctctccatgagagcagctcagaagtctctgttctcactaacccctcaatagcagaaacagcccagaagaagctgcttaactacattttctcctgctacagtacccttagataattcccactacgatttattattttagtagattcaaaattctccccaataaaacattctttatatactacatatacttctggataaatacaaaaataatttaaacttttttaagactcaaaacacaaaatgaaaagaggttaagcagacacataataaataatctattaataacattgttcataacaaagtgtttgtttttaaacgatgcattcacgacagcataattaattagttttgaagtgcacaaaagcatttttaataagaacaattatatttagaattgtcttggaaagaaagtaatttggatgtaatagccaactatatattatgtatgaaaatatccaaatgtaaatcaaagggaagactagaaagcaatttgggggatggggagattgtaccctatggtctgtggatcatctgtctgccacaggaaagtcaggtgagctgctgatacctgtaccctggaaatggacttccttaatctatttaatttcacccttgactgtcctggttaaatcacaaattcattgtttttcatgcctaaagtttctagcctgttaggcctatactcattttccatatccaatttgtggtaaagtacaggatatgaataccaataactgaatgctcagtgtggcttatttctgcaaacttgtcacaatgctaaaaataagccatatatttaaaaatattcatatgcaatagatgggatttaaaatccaaagaggagaattaaaaagacaaataatgactgatctcacagatactaagcctgtgatactctgttgtcattgtagcctgaattttaagagcatgttacagacaggtcagacaaaggcttttgaaaatctaggattttccgaatatgctcatttcgtagaaatgagagcaagcacccaggaattcaaattctattcccactttagcctattctcaaaatgttcttttaacgttgatcaatgtgttttcaataagacttcaaaactatttactttaaaaaatatattaacatagtaattgcccttatatgttaataacttgtgtattgaatttcctacccatatttatcttctgagcctgggtcccatttgcccagacaacttctgtacttgcaatttcaaagttgtcttaaatgtagccctccaaatcgcatcccagttgctatcatagccgaaaactggatattttcaatatatattatttcagtgaatggcataattctgcaccaagccacataagtcagaaaccaggaagtcacatttcattttacccatgtttctagctttccaaaatgtaccgatcgataagtcttgaatttaattcctaaagaaaaacttgtcatatccactcactgctttcaatctgcagtggtaccaggctaatcttgtctcttacctaatcaaataggttttcctaactgctttccttacaatcaatcttgcccttactctgagttaattttctgtctttaagcagagtgatctttataattaaaaccttgcttatttttaaaagaatttaccatttattttaggttataagctaaaatattttggccatctacaactcatcacaaatatgattctagaatgtaaactaacatattttatataacctacaaagtcctccacaatatgccttctccttccctctccagtctcatctatttccatgtccctcttttcccaaagcaaaatagtttttgatcccttgactaggtaaggtttcccaatatatactctcataactctgcctcataatatcaatttatgattacttgattcttcacagaaagaaaactcagtgataacattgaccttgtttctattcctcacggttgtgtccacagggcagattttcctggcacatttttgattccaagcaattatttactgaatgcaaaaacaaagggcctcaatcaaatttgtaacaataaaattaaaacaacactctgtacattaattcccttttttctttttaatttttcaaatgtctttctcaagtgcaagtacagcaggtccttgaatgacattgtttcattcaatgtcatttcattataacaatgaaaaaaaaaaacaactaattccaggcctgagccactatctgtgtggattttgcaagttctccccaaatctgtgaggactttccctgagtactccagtctcctcccacatctcaaagatgtacatgctaggttcattggcatggctacatggtaccagtgtgagtgagtgtgggtgtgtgtgtgagttgccctgagaaggaatggtatcctgtccaaggtgggttcctgccttatgccctgaggtactgggctagcaggctccctgatgggaggccctgaactggtaaataattatctcactttttttgattaatctttcttaaatgcatgtatagctcacatttacttcaatatttaatataagaaatttttggtctttatttagaagtgtggtgatgtttttgtaaccataactatgtcataggaacttgtttatattttgtttagcctaaaataaaattggtttcattttatgtcatttcattgaaagtctcaatttccaagaacctacggacaatattaactgaagacttactgtaatgaggaaaaaattgacagataatttgttgtctaaagataaggtcattggtgacaactcagcagatgtgaaaggctaccaataaagtaagaaaggtgtagataattctgcaagaatttgaggttatttggaacaagttatgaaagattagagagagctcacaataatagacaaagtaaagtgatgaaaaaaaaggagaaaatgttcacttgcttccaaatgtctataatttctattagaattccaagatgttttatgattttaccaaactgtatcttaaaggaataaaactaagaaatttcaaatactaaagtttaaattatatcaaagatcaacttaccttttttttgtcatcttagaatttttaagctatttccttacaagctgcctaaatcaccagtgaactctgtggcacctagtagagtatttgacttaacataatcatttaatttatttgctgaattaggaaatatcttcctctatggaaaattaacaaaatgaataatccatcaaatccttagctttaaccatttcaaatctttgggggagtgttttaagatgttaaagaaatgggtttctaatatattatagtggttgtgaacatgtgctttggagtcacaaaacctaacttcaaatcctaactttggtttttaatagttgtataatattggacaaattatttaacctcttgtatttcattaatggggataagagtaattacaactaactcatatatttttacaacaaggacaaaatgaggaaatctatggtaatttcttagaagagtgtctggcaaaatgtatagacagactaggcctacatttgcttttattagtatccttattttcattaggaatatattcgaataaaatgttttttctatttttttcctttcatgcaagggctgatagtaaatatagtaaataaaccctcagctctcccaaatattcagtgagggcagatcttagttatatatgggattgtgaaatatattgttattaagaataaaagtaattacatgaaatgtcactggtggtctgtagggacaaaaatttgcttgaattcctatcccagataccaagctagatatactctgatggattaaatttactagggaaaaatagactccttgaacttgaagcttaaaaaaagtaatggggttctcacagtcctctactggtcccagtatgcccctgatatgagttggtgagattccacagaaagatcaaggaagagttgcagattttgtgaaacctctattcctgccaacatttctctattatctgtttcgttattcagagtaatctagtctcttgctcatgtgtttgtatttacacagacacacacacacactgaatctattgctaagttcaaagcaatttggcacctcattcaaagaaggtactgtgttctctttaaatttcatgctacacaagcattctgttttcaatttgcatgtcacaagcagcaggagagggacttttctcatttttcctgttgatctttggtatattcattttcaggaaaatacacacaggagtgaaatcttaagacagatactacttattttacattttgactgcttcatccaaaagaaaaagtttgatcttgaatttataaaatcaatggaacaataatctaacttgtatgatctaaagttacagtcaacaaactaatggaaaaagacaatgatagaacaaaagcaaaataaactgagtaaatttaaggacagagcaagtaattcagttccaattcaagaacaggatatgctacttgtgttactctcttggcattactatttgcagatttcagatttcaccatgaagggagcaaatgatattttatgtaccttagtgtcattattaattgaattatataatttgatgaagactttaaaacaacattgtctagtaatatccaccaaattcattcatggtaattactcaacatcattgctttcatcaatacaatttactctagagaccatagctacctcaatctgtacttttaaaaaaaacaatttcttattattttattttattctaactggtctatcaacaacagcagacttgaacataaatggcatttggtcagagaccagaagcccatacttagtcttaagaagtttggccggatgcggtggctcacgcctgtaatcccagcactttgggaggccgagacaggcggatcacaaggtcaggagatcgagaccatcctggctaacatggtgaaaccccatctctactaaaaatacaaaaaattagctgggcgtggtggcgggcgcctgtagtcccagctattcgggaggctgaggcaggagaatggcatgaacccaggaggtggagcttgcagtgagctgagatggtgccactgcactccagcctggcagacagagcgagactccacctcaaaaaaaaaaaaaaaaaaaaaaaaagaagtttaaggttctaggggctttaggaaaaaggcagaatatgaaataaattgtcagtagaaggctgctccaaagatgaagtatataattttaagattgcttttgttgattgaaaatattattgtactttattttatagttttatgtaaatacattgtcaaaacatgttaatctttgtattcatacataattctcttacatataattcataccacatgagttagaaactgtttaggttttccttccattgtgggttacaactcttcttttcttgtctaagcttccagcaagcaaccatgattcaatttgaggaatttaagatgaacagaacaattcttggtccaaggtgtaatattaccactgacatcaaaagaggccatataatgttgtggttaagaacatagcctttgagacagactgcctaggttaaatactagtcacatttaacaccttgctcactcttaggacctttgaaagttaattaaattttctgtagctcagttgcattatttgtaaaatagatgttgttttagagtagtgtctggcatatggaaatgctttctatgttattgtgaggtaaatttttattctaaccaagtgagcaaatcacttaaaatatgtctgttttttaaaaagcaatgactgtcatttttttttttaatatttcagtagaagtttcttccatttttaacattcaaaggaaaaccacattttattagtagatcaaataaggaatggggcatatgttaactttttaaaaaataatttcaaattttcttttatatttaggaggtatacaatatgcaggttgttatctgggtatactgtaaggtttgggatatgattgattccatcatcaggtaatgagcacagcactcaatagttgttttttaaatacttgtccctcttccaccctctccccttttctagatgtccagtgtctattactgacatccttatgcccatggctatgcaatgtttagctgctacatataagtgagaacatgaattatttggtttttctgttcctgtgttaacttgcttaggataacagcctataactgcatccgtgtggctgcaaacaacatgatttcattctatttttatggctgcatagaattctatggtgcatgtgcagcacgtttcctttatccaattcactgttgacgggcacttacattgaatccatgtctttgttattgtgaatagtactgcaatgaacatacaagtgcatgtgactatttggtggaacaatttgtttcctttttttttttttttttttttgagacggcgtctctctctcgcccaggctggagtgcagtggtgcgatctcagctcactgcaagctccgcctcccaggttcacgccagtcttctgcctcagcctcccgagtagctgggactacaggcgcccgctaccatgcccagctaatttttttgtattttcagtagagacggggtttcaccgtgttagccaggatggtcgcgatctcctgaccttgtgatccgcccgcctcggcctcccaaaatgctgggattacaggcctgagccaacgcgaccggccgcaatttgttttcttttagatatataaccagtaataggattgtgagtctaatagaagagctggtatcaagtctgaaactactctaaaatatcaaggaggagagtctgctccctaactcattctacaataccagcatcaccctgataccaaaacctgtcgaagacacaaggaacaaagaaaactataggtcaatattcctgatgaacatagatgcaaaaatcttcaacaaaatacttccaaggcaaataaagctgcacataaaaaacttaatctaccattatcaagtaggcttcattcctaggatgcaagattggttcaatgtatgcaattcaataattgtgatttatcacatggacaaaattaaaaccaaaaaccataaggtttttgagaatctccaaatttccacattggctgaactaatttacattcccaccaagagtatacaagcattcccttctctgtgcagcattaccagcatcttttgttttttgacttcttaataatagcattttgactggtgtgaggtagtatctcattgtggttttgatttgcgtttctctgatgattagtgatgttgagcattttttcatgtttgttgtctgcttgtatgtctgtttttgagagaagtctgttcatgtcttttgccaatttttcaatgtggttatttggtttatgtttgttaaattatttaagtttcttatagattctggagattagacctttgcgggtgcatagtttgaaaatactttctaccattgtgtaggttgtatttttactctgttaatagtcttttctgtcgggcagaagctctttagtttatgtaggtcccacttgtcaatttttggttttgttgcaattgcttttgaggacttgccataaattctttgtaaatgcaaacatcaaggatagtgtttcctaggcttccttttaagattcttacagcttgaggtcttacacttaaacttttaatgcatgttgagttaatttttgtagatagtgaaagtaagggtccagtttaattctgtatgtggctagccagttaactcagcaccatttgttgaatagggggtactttccccattccttatttttgtcaattttgtcaaaaatcagatgattgtaggtatgtggctttctttttggattctcttttctgtttcattggtctatgtgtctattttgtaccaataacatgttttgttaccagtactatagccttagagtatagtttgaaaaaaagctatgttgtttttgcttaggattgtgctttggtttgaacttgtgtccccatccaaatctcatgtcaaattctaacctccaatgttggaggaggggctggtgggataaaactggatcatgggtgtaggatttgcccttgctgttcttgtgatagtgagtgaattcacacaagatctggttgttttgaagtatgtagtaccttccccttcattctcttcctcctactttggccatgtccccagccatgcttcctgtacagcctgtggaaccaagggccaattaaacctcttttctttataaattacccagtctcaggtagttctttataatgatgcaacaatgaactactacagattgctttgtctatttgggttctttttggttccatatgaatttcagaattttttctaattctgtgtaaaatggcattgaaagttcagtagcaatagcattgaatctcttgattgctttagagattatggcaattttaacaatattgattcttccagtcaatgagtatgaaatgctttttccatttgtttatgttatctatgatttctttcagcagtgtgcagttctccttacagaggtctttcagcttcttggttagacgtactatctaaaagccctacttaaaaggcacagagtgatgggttggataaagtaacacccattcatctggtatcttcaagagacgcttctcacatgtaatgatccccataggctcaaagtaaagggctggagaaagatctatcatgcaaacagaataccaaatggaacaagggtcactattgttatatcaaataaaacagcttttaaaccaacaacaataaaaaagaacaaagaagggcattacataatgataaagggttcaattcaaagacaagacttagttatgctaactatatacatatgcaatattagagcatccaaattcatgaaacaaggacttctaaacctacaaaaagactgacatagcacacaatgatagtgggggtcttcaacaccccactgacaacattagacaaatcattgagtcagaaaacttccgcagaaattctggaattaaatttgacacttgacaaattgagcataattgatgtttacaggacactccatatatcaaccacagaatatacattcctctcatctgcacacagaatatactctaagatcaaccacatggttagccataaagcaagttggaaaaaatccaaaagaaggtctttccataaaacaagtctcaaagaaatcaaagttataccaatcacataccaaccacagtggaattaaaatagaaacctataacaagaatatctctcaaaaacacacaaatatatagaaattaagcaactttgctcctgaatgagttttggattgtaaggcagaaattttaaaaaattcttttaaataaatgaagaaagacacgcaaaataccaacatctctgggatgtgggaagagatatgttaagaggaaagtgtatggtgctaaatgcctaccttaaaaagttagaaaaatctctgattaacgatctaacaccacatctagagtaactagaaaaacaagaacaaactaactcaaaagctacctgaagaaaataaataactaaaatcagggcaggactaaataaaattgaggcataaaaatccataaaagcatcagcaaaaccaaaagttggttgtttgaaaggacgaataagatctatagaccactgactatatgactatataaacaaagaacaaaacagagaagatccagataagcacaacataaatgacaaagatgacattacaactggtccaacagaaacacaaaaaaatcctcagagactattatcaacacctgtgttcacacaaactagaaaatatacaggaaatggatatattcctggaaacacacaatctcccaaaatttaatcaggaagaaattaaaaccctgaacagaccaacattgagttccatattgactcagtaataagaaacctaccaacgaacaaaagccccacaccagatgaactcacagccgaattctaccagatgtacaaagaagagctggtaccaaatctactaaaactattccaaaatatcaaggaggagagactcctccctaactcattctacaatgccagcattaccctgataccaaaacctgttaaagacacaaggaacaaagaaaactataggtcaatattcctgatgaacatagatgcaaaaatcttcaacaaaatactttcaaaccaaataaagctgcacataaaaaacttaatctaccattatcaagtaggcttcattcctaggatgcaagattggttcaatatatgcaattcaataaatgtgattcatcacataaacaaaattaaaaccaaaaactatacgataatcccagtagatgcagaaaaagctttcaataaaatccaacatctcttcatgataaaaatcctcaacaaactctgtatcaagggaacatatctcaaaataataggagccatatatgacacaatacagctaacattaaactaaatgtcgcaaaagctggaaccattccccttaagcactggaacaagacaaggataccattctccattctcaccacttctatttgacatagtactagaagtcctaactacagcattcaggcaagagaaagaaagaaaatgtacccaaacacgaaactaaagaagtcaaactatctcttctataaccaggaaacctcgatgacatcaccaaaaagctcctgaaactgataaatggcttcagtatagtttgaggatacaaattcaatctataaaaatatattaacatttttgatgtgcatttaacatactaaaatcatgacttaatatatttcagtatataaccaccgattgtttaaattacatagtgataatggaactatactttctttttaaaaattatctgaggaatgtttataaataaactaaaaataaacaactcttttttgatacatacagtagacagtatacagcttctaaaagctctttacatggtgaaataagatctgttattccaaaatctttccaaaagaacttttctgttattagcttgtttttcaacattatccaacttgtctctgtgttttgtaattgaaatataaaggagaaaggaaaaggataatatttgtgtccatgtggaaaacaaaattattcatcaaacactttatgaaaagcagcttttatttccatcttgtttctgaaagctaatttgttattttttctaattattcttaatgaggaggctcagaggaaattcttaatcatgattcttactaagacactcaacaaggtcaaaagataaaagctgcagaatcaatgtcactgtttaaaattacactcttccaacagagagattcttaataagtctttgtttgcagagtactttgactactaaataaaattctttgccacaagacagttatgtgtacttaagctgcattaaaaaaagcaaactgtatggattaatttttgaaacaaaaattataagcatttaattacttattaaagaacatatccatgtaaatatgtccttagctgtccagttgtgacagatgttagcatgaaatagatgtgccacatttacaaggtacgggatgttgaagcaattttcctacttaagtgaagtaatataggcttatatttctggaacttcagaagactgtgctaatatttacctttctgtttcatcatctaggatataactatttttcacttatgtgtgaagcaggaaagttgttagacatagcaggaaaaagtacttcgtatcactggctggcagagaaagtttatatatttgagtttatacaggtaactggaaatttagaagtatttttcattgccttattttcttattccttgtcatgaagagtgtttggactgaggttctactatgaaaggtgaatatccaagggtggaatgagtagggactgtggctgagagttatgaaagaagatgattctgaaaaaaataacagaaagcataaagcaaatatttcctactttttccatacatcacatcttgctttctcagaaatttctctgctacaaacccacctgataacaccttccttagagccatagagccaaagtcattacagaggaatgtttcatatagaacaggaagttccaaatgaacctatgttctttttgatacgggagtactgggaagggaagagcgtggtccctttaaatgacatggaagggggaaagggaagtgctgagtggagaagggcgtggtccctggctagggctccataggtgaagactggcgctcctgcttttgtgcccaaatgttgcattttccaagaccaccctggcctgccatgcccccatcctgggcctataaaaagccaagaccctagcaggcagatacaaatacaggtggatgtggtgaggaacacattggcagaagacataagcggctcctagactccaaaaggatgtcgagggagcacaccagcggaagagcacaccgacagacactggcacgcgtgcaggccacccactggtggaaggaggcggagtttggtccggggaagttggaggagagccgtggccccccaaaactccgaatggcccactccaagggaaaaccatctcccttctggctcccccattggctgagagctacttccactcaataaaactttgcagttgttctccaagcccacgtgtgatccgattcttccagtacaccaaggcaagaaaccccgggatacagaaatccctctgtccttgtgataaggaagggggtctaattaagctggttaacacaaatcgcctatagatggcaaactaaaacacatgccctgtaacacatgcctactgggccttcatccctagacactggggtcagagccccacatcctgcccatttgcatgctcccctagaggtttgagcagcggggcactgaagaagcgatccacacccccaacgcatgccctgcgaggaggacaagggaacctttcccatttcgttttcattgtttcacaataaagaagtgacaagggatggatgtctacctatgtcaactgtttttaaaaataatatttcatgtaatgaactggcctatgaaatttgatcatatgatttggatcattcttgtcacacccaattaaaagaaagttgactagccaggggaaaaaaaatcaggacatgtagcatcgctctagaaacgtaattttctgcaagtctggctgttgaaactgcctattctaacccgagacagttttatttataactgctgagacaacttgcaactccagggctaattttccccaccgctgttgctcaccaaacagagtttgccagctccccagaaacttactagtcccaatgcactttctctaagagcaatacataacatttctcatttttataaaatcaccaaccttctctttgttcttcagacataccgaagaacacctgacccgtgtgtatgctccaaattgtgattctttattctcaaagaaaacattgaatttagagatccatctccacatttctattttgacttcaacaatcccattctgcatcataaaccttgagagaataatatccaaaccaagtcagatcagtaatttgatctgacatttcttggggtgaaagaaaacttttgttggcaagtttagcaaaagggactttggccacatgctgaagtatgcatatgtacaaatgaattacttcaaggaaaatgagctaggataacagtttttatattggccataaggataaaaacacattattgattaactgcattttttggagcttggaagttttcttaagaattctctaaaactgaatataataaagtgctaagacaagtattttaccacccttgacatttagaaatgaagtttttgatagtttgttatccacatgtataacatatgatgtggaaagttttatgtcctgctgagcttagttctcataggctcaattttagacaatttctatacagacgcctgcaattttgaatatctgctgctatttatgaggccttcccaagggtggtactccatatttaatttaattgtgtttgcatatatcatacattttgccaacagtaagctctaagagcactttatagttgataacaacttccttcattgctttccaagctatatgatttcttactataaaaccagccttccaccttcagtattgttagttctaacggcatacacgcaatggttttctctactatgttcaaaaagagggtaaaactactaagagtggaaattaatctgttaaaaatttctgttacattaacagcattttattatatctctcctcaaattaatttacttgagtacagtgctagaattgttattctgttgttagactttatgccataaattttggtaatatgtctatcatcaggaggttgggattttcaaaatttttcaattatcataatcagagacaagacctaggaaatgagatcaatttagtccctctaatcacaaatgtctgtactctaaagttcatgaacttgacactaagggaaagccccagaatggattagaaaatgctaataaaagtggagaatgtgtgggaaaaaaagacacctggctaaaggaaggcatgtttccaattttagagcaaggacagagaaatttttacagtagatataagaattcacaaagcatagctgtctggagcaaataatgtctttctctactaaaatagcttcaatactactttgttgcagattgtactaattaacagttatgttaatgatggtaactcatcatcacaatttttattttatgcaaactctttaaataatagaaaagtatgcaatgtattttagaaagatttgtatccatggaacttataaccaaaacaaatgttaattaaaataaagtaatatttttcttctgtcaaattgtcaaaattttattaaaaataatagccactattggttcaagtaaggaattaaaattattttataattttggtgtagctataagttgtttctatataaagaaagaaaggagagaaagcaaggaaggagggaaggaaggaaggaagagaaagaagacaaaatggaaagccaatataccaagaacttttaaaaactgtcctttgaatgaaaaattttactttgggatctatagcaatatagagataattaaagaagtatatattgctgctaaaagtacttataatagtaaaacattatatatgtttattaaatcattatgatttaaacacactctgtaattgtgacagatactgtatattggaccacccactctaacacctcttcttgtatttttctttttgtgcactattgaggcagataaacttaaaactgcacttgccagactcatttgcggatagggtctaccttggaatctgcgaagcagaagacactctcatgacacaagaacataaaggaacaagtgagccaaagggaagtcagttaatcactgggcaggaagtgtatggttctttgggggcagctgtggtagagaaattagtgcaacaccaggttatgatagttgccatgatggggattgtacctatgaggtttccactagaaagttcagattcgtggttaggtatctatttggctctcatgatcttgccgctgtggcatccaagcttagttttctgatgcttctaagtcactagaccacattagtaaattcattacagatgaaagaggctacctggattctatgaaattggatgaatgaataagccattaaaatatatattcatgttgttaaataaattttgatgggatgagtaattctcatggaaagtcaaaaaattataaagcaggttttagaactgtctgtacattcttagttttgagtgtgaatatataaagtctttttaatattaaagactaaataaatgaaacattattattgttattagtgatttcttattgaattcctaaattgcttttaggaatttattataagaaaatagtgtcctttgcatttttataagaaataaatgcattgcatttattataagaaaacatgacaaacacaatttggaagcaaaaataaggaacttcatttgtttagaatacttatagtaaatatcacaaagattctaaatagaataataaccttatcacaatataacgtaagaaacactgtaatgtgaaatctgttttgttaaaacacatttagatttaaaatttcttaagccattggatatgccttgttatcagtgtcacacactgaaaacttctagaagttgtcatttcatctgatacatgaagagcaacagttattccttaacacctccttcaacaccgcatgattctcctcaattcatattttgaaatttgacatatggcactgatggtgatatgacagagagaatctcaatgtgtcaatgacttcatcatattcatttgggcaactgagctagagtcttctgctccatgaagtctgtaatgacattgtgggaaagctgtaggcaggagcttcatattcagatcaaaggcaaatacaaaccagggaagagctatcttccagtcaatatttgttggcatttgctatattataaaacttcaagcactctcccatttttctgctcaatttttcttccattcattgcacggtgagatatgttccaccatgaacaaaggaagttaataagagttttcaaagatacaataaaatagatgaagtttaatatgacatttaaccctattgcttctcaaacaaaatgctttatatacatagcaagctggcttgctatccatcttctgtcactattctctttgtttactattattttgttttaccttttctaaaatgtcaaatatatcagacacacaatagagtatctgatatatttgtagagcttaaaaatcaataatactacaataaaatgaatatttatgtcaccaccacctacaatcagaaataaaatcctgccactatcttataaatcttctgtgtgcactttgatagacttttgcaagttttagggctgtataaaatagatttacacagcacaaattctgcaacttggctatttctctgcattattatgtttttaggttaatccatactgatgtatatacctttagggaaataatgctgtaaagtattccattatataactggatcacactatttacctgttctttattggagagattactgttgcaataatttttatttgtattatgaacaaagaccagatgcatattctggcatatctctcttggtgcacaatttgaggaatattttaggacatacccttaggaacgaacaaaagtgctgtgtcatgggtatagtatatatttatatttacttagttaaaatcaaattattttccaaattggctatgccattttctcagttaccagcaatttcagaattcctctttctccccatcttctataagatttgatatgatattaaacttttgtcattttgattgttgagacttgatattttatgtttttaaatttacatttttttctgactacttggcaacttctcatgtgtttaatgaaaacatgcgccactgcactccagcctgggcgacagagcgagactctgtctcaaaaaaaaaaaaccaaaaaaaccaaaaaaaacccatatatatatatgttttatatatatatttatatatttacattttatatttatattttatatgtatatacttatatattttatacatatataaaatactcacatgttttttaatgtggcttatttaaggaaactttactgatcatagagacataaaaatatttttcttaagtttcctttaacagttttagatttttgtctttcatatatgtcatccatatatgtgaaattatctattgtaattatttattaagtgttgaagaaccattttaattttccacatgagaaataaattatttgaaaaactaaggaaagttaattatatccattttcacctctaaatatcacctatttatacttctattttccatggtatattatggatccatttctgtacctttatatatatatgtatatgtgccttatataaattattatataatatatattattgtatatatttatattatatatttaatatatagtatatattatatataaatatataatacttatataaatatatatacatatgtttgtttcacatatatatacaacattgcttggttcaatttgttaataatttcttaggaaaatttttatccctcctgactttctatggtttttggtgacaacattttcctgtgtctttgaaggctgaagaacattgtaattttgttgcctagatgtttcttggatttcttccataaaactttttgagcctggggtttattgtgtagggaaaacataattgctagtgctagaatttaggttttctatcatgtcagatgtcgctatgtatagttaatgtttttctagaaatgtgtctattttgtacttttttcaatttattaacatatatatttcatatcatctttatctaaaaatctcagtctcttctgcagctataatttcggcaataccagttttaatattatttatttggcttctttctttaatttctatttttcctgttcattttaattataaattaaataatccttggctttgttaagtctgcattattttgatactttatgttttttattatttatttttatcttctttgtccttattctcttttctttacacacacacacacacaatatttcagatagatgcttattttgttgattttcagcctttcttcttttcaaccatgagaagttaaggctataaattgccccctcaatgcttttagaatcacatttcaaaaatgttgaaaatttatattagtggtaatttagctacaattgtcttctaattatgatttcttttttacccataggttatttaaaagatagttttaataaatacaaatgtatttattttacatatttttattactgaattactaatttatgtagatgtcagagaatgtgggtatactaatagattcttttgtaaaatttatcgaaaccttctttaatgcctagtatatggcccatttttaaagtttcatttgttattaaaaataatgtatgttctacaacttaacagtagtagtagtatcaaacctatacctttggtataggtttttatatatgtccactggaaagtttaagtatattttgatatattcagtatcttattgagataggatattgtgtctgctaatctatcaattgttgacaataatgtgtttaaatcttctacagtgatgtttgttaaattatttttgtacgtctgcgattttttaatttatattttaaactatgtagctaggtacatgcatatttagaattgctacatcttcttagtaaattgaacctttataattactgtatagtggccttctttatagctagtgtatttttgccttaatgctttatgatctggtcaggcaccagattttatctcctaactcctatagactctttaaaactcttaaaatcttaaaatataggatccagaccacaagcaatttacagacgctccaaaacaaatgtggattttaaagctttcttacatcaatagactcatgctttcttatcttatctgattgttgaatgattctatttctttttccatgttatcaccacattttaaaaagagtttgttttgttttgttttgtttttgttatccgtgtttttagggagtagttttctgaaattccagtcagctaaaatcctgaaataggaaaccaactgttattcttacaacttccactatgcaacctctctctcgctagaaaaatagtatttgcaaatatcaaaatataatcccctttcctgttaggtgagctgcatgcaattaaactaaacataatttatattttaaaaattattttttgccattattttcttgagccagtgagttctcttatttttgcccctgtgccttagtgtatgtgtctgtgtgtgtgtgtgtgtgtgtcacatgtgcgtgcacacacatatacaatgtttgttgtatttttttctggttaactgagactaaacttgaaatttaaagctggccttccatgaaaattatttaatgatgcaatgcaaagacaaattgctttctacatcaattttctatgcaagtacctataaatgttagataactaaattatcccagagttttcttcaggaaatatcagccttttattcaagtatatgattttctataaagtattgctattataatcttttaatgctaggtgaatccacatcaagcattcaatatttgttggatgatacaattaaatttctctctgcttaggttgagtttacattgtctttaaaaatgtcttttaggcagggtgtagtggctcacacctgtaatcccaaaacttgatgaggctgaggtgggaggatcacttgaggccaggagttcatgaccaacctggcaaacatggcaaaaccccacctctactaaaaatacaaacattagccaggcatagtggcacacatctgtaatctcaggactagagtggacgaggcaggagaatctcctgtacctgggaggcagaggttgcagtgagctgagatcacaacactgcactacagcctgggctacaggctgagactctgtctcaaaaaaaaaaaaaaaaaaaaaaaattaatatcacaaacatggtaaacataaaaattatcacagtgtaaaggaaaaagtaatatatactcacaaatataaacagacagtgggagtggggacaaatttgcattcatattgaatcaagacatttatatcgcctctatacaaaaacaagatgaactaaactaaattaaagggatgttaatctagaaattaaatgtatcatgtcagctagttttaatatatggatgctttgggcattgtaagattaaactttctgaatcataacagaatgaagctcattaaaataaaataaacttacccaaatggaagatgacctaaaagaataatttttgggcaaaatattataaaaatagctacacagatattagaaaatataacaagcaaaatttgatttttactttggtgtacaatgtcccaacattctgaataatacatacccttttctcttgaaaaatatgtatatactgaatgactttaaaacaaatctagaaattaaatgtatcatattttccatactgtttttgtttcaatcagattttttaaaagaactttcatctctaaatttaggaatctctttttacaattttttcatttacagctacctcaaaaaatagtatgtattcctaaaataatatagtataaatttattttgaacatcaaaaagaatctgagctcacctatagcccacaaatggaaatgagaaactcatgtgttttcatatttataaacacatattacatcttatacaacacattatgaaaaagaaaataaataaaagcatgctaatataatttgaatgaacaagaaatgctggaaatatttgaattctacctttcaaccacattaattagagcttccactaaatcatttccagactcatataactgtaataatttcacacctataattatctctccatgttccctgctatgtttattttacttaaattagacatatttcagtatgttctgaagattttgccttatattcaacattacatatttgtttaaactcctcccttcatgaatgtactctcctctgattctataggaccacccctcatctatttttatgcactagctccattatgaaacctttcaaaatcataaaaagtagaaaattttattcatagttcacagttgaagaaaaggcagctcataaccttgaagcctatatcctactgtgatactctttgtaaatgatagtatgagaattaagcctttatttaaaactttttcatgtcaatgtcagttctgtctccaaaacttaaatggcattattaatgaatgtgttacaggcattacaatgcagtgattaagaatacagccgctaataccagcttccttgagtttgaaacctagctcatggctccctcctcctttgttttgggaaaattacttacactttatgtctcagcttccttattggtaaaaaatgtataatatgcaagtctaccttatagaattggtggaagcattaaataatgcagttgtgaaacatacaaaagagtatctagtggatggtaagtgtaaaagtagtattaactattagtatctactatatggggttgtgggttgaagtccactaataatttgtgtcaacattactctggtaagagttcatggcaatgacttgttgattctaggaaatttctgttcatcaatgtattgtaaaaaataaagaacttcactgttttttatttttccatgaaatgcctacagatcaatttactgaagacaatagtctgcttatttgtgcaaacagttcacttatgaaacaagtttatttcttcactatacctaccaattctaaattattatgtcatggattttttccattcctaatcagttccttctcttgaaagatctgcattacacaacttgagaccagactccaaagctccataaatatcccattctgacctcttttaaacacttctaagattctgtcagggtggtgtgctttttgattacaatgtattccaataaattcaggtgtactttacttacagattatctggtgatatattgaggagagcaatgaactgtaagcaccactgtgttctagctgagatcccctctctgatgtgtcttaagatccttgacttgcaaaatgaatgctctactggggaagccttgagagactctgcaactgtgatggtggggtctaggtattgatattgtgtctcaactttggtcactgtcaagttcccaaatgttagttttattttgtctaatgggaaatagaatctattttaggactttttctgtgatctgtttagattggaaaatgttaatgtttgatttaaatctgctttattgctaaattactcaattgtgtccttctgtcctcatttttgtgagtctctaagaggaggtttatacaaaaatggccagacatggatcctgataagttgattcctagagccagctctggaattaataacttcagaaggttcctcctcggactggtatccctcacataaattttccctggagtcaactcttcaaaaccttaggcaaatgtttcttattcttatcctgttcagtctttgagagtcaggttctgtataaaatctcccattaaaaaagtttatgttatccaagaacctcagattatcgaggctgggattaaaaaaaaaatcattaacttggaggcctgaaaacactatgcaaaagcaacactttctactgcttgttgctagattctcatggctttgaatcacactaagtgtatgccttctgtaggctgaacccttgcctcatatatgtatctacattataaatctaatttccatgactgtctttcaaaaaggcataatttctttacaaataatttacagttaagaggctacttggtgaaatttttatattaacagaagttgttaatttgagaggagtcttaaaatggaaaggaggtaaaattcctattacaatgtgaacttaatggccttttccctactttttattttcccctgtctttgtttactcaatacccttttgccttactccattttctcacctggccccttacctcctggattacacaacctgagtttcacaaatctcaattgcctcttaaagttaagtcctctttagacatcaacaagcttcttatagtttatttttagccttcattctcagtctgaactaagaatcaatgtaaaagtctggacaaagtacagaggaatttagaatcattctaacaacatatatcgtaggtttcccagatctacgtaagtgattcttatgttagtaagaaaattaatgtaaaaaaattggattaaaaaatgaagacttaggataatctaaggtgaatgaaagaccctgaatattagagaaaaccagaagtatttaggaaagctatacacagtggagaaaatattttggaggctaccccaagactttcctgaaaataggttggacttccatctcattataaaaagagaaagaatgaatcaatttgaaactttaggaacaggacctccaacacctttagaaaatattcaggagtagatcttgagacagacaggacctaaaccctctcatcatttttgcaaagagccctaaaccaaaattagggaatgtaaaatggaaaaagtacatcggaaaatgacttcattgacaaacagaactccaattcctaactgaacattttgaaaaagtcatggaataaaaacagaataagcctctgaataagttaacagccttacagatgaaacaactggctatttctcctcaatttatcaagtatcagaggaggaagcttcctgaatacaaacattgatagataactgtaagcagaaaggacattggaaaaagattcataaaggacattggaaaatagctattctgcactaactgtgaaactaaaagaaaatttttaaaaaggaaggatgtgataagggaagttgatgctgatctgtggggtcattaattccctgatgtcccatttctctaaacattaacagacagtatcaaggtttctgattgattcaggcacagtaatatagtttacagaccctgccacacatgcattcagtcactcccctagagtcaataaagtatttaggagatgagtatttgcaaaaatctacagattattgtgtatcactctatagcttttgccctcagatctttaacatcgtttgctcatttgagacagcacttcccctcatttaataggtagggatttcctatgtaaacagaattgctaatttaagtgctctcttgatgggctttctcttgagatctctaaagaatcacctattcagcagggcacggtggctcacgcctgtaatcccaacactgtgggaggccgaggcgggcagatcacgagctcaggagtttgagaccagcctgaccaacacggtgaaaccccctctctactaaaaatacaaaaaaaaaaaattggccgggtgtggtggcaggcacctgtaatcccagctactcaggaggctgaggcaggagaatagcttgaacccaggaggcagaggttgcattgaactgagatcatgccactgcactccagcctgggtgacagagcgagactctgtctcaaaaaaaaaaaaaaaaaagaaaagaaaagaaaaaagaaaaaggaaaaaaaagaatcacccattcataatcatatcacacctaatttggactatggagtacaaggagcctggtatcgacatcaaactcaaattgaagatctactgatattggctgaattattggggaagaacacctcacatttctcactgacccatttaagcctccatctacacttgccctctacaaccaaagggaaaggacaaaagccagcagttgtgtctaacagaaaaataattacgaatactatgcactagtccttggaacactcctattcttctgatcaagagatcccagtgggctggggtacccatttatttcagaccttgcaactataaataaaatatttagccctgttttcctgtggtgccaaaattctatattattttaatttccatgctacctgagattatgtattttagcattctaaatccatgttctgctgtttgtattgtcccttttagatcataatagaaaatactcattagtctttctctagaaaaatcaatgatgtacctggacagttttactgcagaagtgtactgaggcacccaggtaccttatacaagtcttctgctagacactgaaggaccttgaatctctctataattctactcttatccaacatgcagacaatttttgctatgttgtcaagatgagataatttttcaggttgattccaactactacttatagctcagaaagtatataatgtgttcaaagaaaaattagaattttgtaagaagaaaatgcactatttagaacatgatttataatccatcactctggagagattacaaaacactttttttttttctaaaactgttaagaaaatatacttattttaagagactttttttttttcggctgtagggggtgaattttttttttttttcagtgagagcaggttaattaggaaagtaaaggaataaagaatggccactccatagagatttcataggttattacatgcaatgggttcccaatattactgaaattactgtacctctaaattttaacttagttgttagtaactcaatctctttgttgtattataagcataattagctgtaggggtgtgtctctgtgtgccctgggagtggcagggttggggttgggggtgggaggagtaggaggctgtgtgatttaaaattaattatttggccttcctaattatcttagatctttttaccaatttgtgcatgatcaatttggacaagccattggtgttttgactttactttatcagaatctttaaagactattcatctttaaagttatccataaatttttcatagactcagtggcaaaaggctactcaccttgtctaagggcaacagccagactagtgggtaattacagtgggtaatcttctgatgtttctgcattatattctctactcttcacctaattacctctgaatgtcaccaaaactgtacagtaaattttaatcacacaaggaaggtattttggacaatgataagtctttgggtagattctaaagaccagtgttaggtttgcaaaacaaaagtctattgggtgtggccaacaaattataccaaaaaattgttatctttgtaaatttagacactatactttcagaatggtgcctaatattactcatggatgatttgggcacatttccccctcaaaccctagaaaaagagaactctagataatttcattcaagaaagagaaaaacagggcctcattttgagatatacaacattactcatgtctaattctgaatagttttctcctgtctttaaatcatactatctgtgcttcagatattatcaggaacactgaacaatttcagtgaggccatagaaatcatcacctggagatttcataatactgaggaggtggtacttcttcaaaacatagcagtacgagaaataatattggcctgtcaggatgaaacatgaggcattttacaggaggaaagtttactcatattcctatagttctttctgtttttattttattaagaaaatatgggaaattttttaaaaattacaagacaaggtgataaatctagtattcccacatctgaccattaaaactttttggtttggtcatgggttccattgtattgctttaatttaggcatttttggctcttggcttagaatgtaaaatacttctgttagtatctgtctgtgattcagcattcaaatatcaggttttcataatcaaaaatatttctatgtagccactctgatatgacaataaatgatcatgcagccaaaacaaaaacaaacaaacaaacaaacataaaaacctaatgtatatgatagttgaaatgatcccaccagaaatctgatatgcaatcaggaccctgaagacagtggtattgattttgattgattatttgtgcagatgattattatttatcctccagcttaggttgaaaaatgactacaagagagttctgagaaataagaaaccacctatgttaacaaaactttttattgtttgcttcaaaaatattttctatgaaaggataaaatcataagccaactaattttattattttcttcaggaaatttccacagatcaatttattagagacaacactctgctcatctgaataaataatttatcaaacaacagtttacttattgaggctgcttgtttccacatgcatctcgctctgcccaccagtcttaaattactatatcataaactctgtataatctcagttaattccataccttaaatgactcagtttaaatcactttaccacaatccccacacacgttaagtacctcagttttgacttccctcttctgaaacattgctatatcattgtcaaggtgatgtttactcttacctattgtagtaacttctataacatttaaattttattactacattatcattcttggactaaacagttaaattgtagttattgttctttcttctattactattaatactactattttggtatttctccatcatttactgttgtgggaaaatgtgagaaatatgactgtatatattttattttattcacccaaactagaatatttgtctcttttatacctctccaaagaccccacttctatttttaaaaattagttgatatactattttgtatacatgtttgtttctatctgcttatttagtttacatgtttccttttattctttaccatctaagtactcaattcaaataagatacagagataaggtcagtttctgatagccaaagaatagcaataggtttggcacaagaattgcgcaggttcctcatgaatttgactctaagaaattgtgaaatctcggggaagacacacgaaggcctctgcatcccagttttcccttatctcacttttctcttctcttttcttttatcatatgtatgctatgtgagaattacaataattaaaatatgtaacatatgagaattaaaatatataataaggatagagcttactacaacacctagcacatcctaagtgctcaataataatccttattactttgtaatgctcctgtgagtctgaaaaataatgtatttaaggctcctagtagatactcttttaacaggaactactaatcttgttattgatattaatatagcttggctatattaatccaggtggatcaacatcctctgtataaatgaaaccacctatttacaaggtattccacaataattcaatgttgcatcttcagcaagaacaagccataggtctgaaaatgtaagtgcaaggcattgagtatgcatttgtgtatgtggtctgattattgctctgaagataaacaactactgagaccatatattctgaatcctcttacaggaatacagtatatgattgaattttttttctatctacagcttgcaatgactaaaaaaatgttggtttgttcccacaataaattccctccaagaccacaaatgagaaataccactttacatgtgcataccttaatgatgacctcttcttgaaaacaaaacaagcatgctttagacagaattagcttctcactgtagagatgactggcttaaatgagaattctgtctttgctctaataagtttatttgacatcttggtttgtcttatagtaaaaaaaaaaaaaaaaaaaaaaaagaaaagaaaaggtggtttgctccctttccccatggtgttaaattaattccatgagcagttttgttactctacacaataatacagtgtgtccccttatttatgtcataatgtgtcataatgtctattgggaaaagagatcaatttatgtaactcaatttgttgtctttaaaggagtttaacattgtatttgagctggacattggttgccttgagctttgagaatttaggctgattcatcatgtgaacctgttgtagaaatgaccttctctaggcttctgctttagtttttacatgaatggtcctaatgtccgcctatagaagattttgtgcacatgatgaccttagggttaatctacatcgggaaacacttaaattaccataataatgttctctcgaaattcttaagtatgattaatgttggttatgtatcggcctagatagagatttctaaaagtgagtgttcctgagtgctttggatgatactttgtaagcatatagacatgaaactatttaaaatcattgcataatgttgcaatatatcaaattattttcctcttgacgtatatttagattgttttttgtcactcattaaaagaatgctacaaggagttttttttatgtacaacactttgtgaccatataaaggcagttgcctagatttggaatttgtatataaaaaatatagatacacacttttgttaaaagcttaaaatttgccctttcaaaagaatgtacatatttaatttttcaataatcatgtataaaggtgtcagctgtattttcataagtttaaatgaaaataactgcttgcgttatagatttttcttttttatgttataaaataaaacttgctctaatttatgggtagaaagaatatgccttacaaatttaattaaaagttttaaatgttaggatataatgaaaatcaccccattcttttttatttccgaaacaagaaagggatgttaagtttttcaaaattgattcacatgagctaacattaaaaccattggatgggttgtgtttgtgtccttgccagttagtaactttattataaaatctctaaatctattaccttctgtaaaatgattttgaataagcatctgtgtaaaaattgttttctttttcactggattagaaactctgttaatgtgaacacagtaaatgaacttaaagaaatagtcaagagtaagaaaatatgagaaaataacttttaaaaataagttggcaagtcaagttctatggaaaaattaaaagacgcttaaacatcttaagtaaaatttcaacatgcctgttacgacacatccccaggaagtttattttcataatatttgatgtgattttaaggtcatcatttaagagaaaataaaaaaggtcatgaaagggattttccacatgagggcttccaattgaaaatatttacatataaaatgttaattgtagaaatacaatccaataatgaacaaagttcaaaagtgagtaaaccctgaagcaagacaaggcaagatatgtaatatctatcaataaaactaaaacattttcaaacatttggtgggaaagactatcttagttaatcagggacttctggcttaaggaaagaaagcaacttgtcagatttaatcaaattcatgggaatcaatagaattgttttcttttgttggttttcccagatatatgtaccaatcagcagtggtgataacttagatgaaaggaattggtggaaggagaaaggtctcttcaaaataggatattatctcacttcctaggtttcataatctctaataaagcactcctaatttaaattgaaaaacatcactgtttatttcatgcaataaattaaatcaaaatatataactggtttgatatttgtttccaagtatttgtcagtctttagtcaacaattcattaaaatgaaaaaaaccttaattctgatttacaaaatgaaaactatcaatggtaattattattattattattatttctatttttagtagcgacagggtttcaccatgtcagccaggatggtttcgatctcctgacctcattatctgcccaccttggcctcccaaagtgctgggattacaggcatgagccaccgcacccagctttttttttttttttttttttttttcctgagattgtatctccctctattgcccaggctggaatgcagtggtgtgatcttggttcactgcaacctctgcctcccaagttcaagggattctcctgcctcaacctcccaagtagctgtgaatacaggcgcctaccaccacacccagctaatttttgtgtttttagtagaaatgaggtttcaccatgtttgccaggctggtctcaaactcttgacctcaagtgattcacctgccttggactcccaaagtgctgggattacaggcatgagccactgtgcctggcctatcaatggtaataccttattgtagtatgtaaggattgtataattctattggatcttgaaaggttggtaagaaatcactgaaatgagtaagaatggaattcagtaactcaatattgatatcaagaaattagaagagaaaacaatacattgtgcataatgaagccaaagataagttaattattccttttatgaaaggtctctcatggcatacaaagtcatgtgatacacagtagcacacctcatctcttacatatgaaattaactaggaaagtgtgtttttcaaaatgggcatgaagacattagtttcacaacatacttatatataatacctagatatacatacatgtaacatatacaagtatacatagcacatgcttcatatatatgtacatatatgaaatctcactctcagtctctctctcttgatatacagacagaaagacagagaggtagagtttcatgtatagagagctatatattataactctttatatatagcacggaatgattgaaaccaaatcatttcaggtccaaaaacatacaagtaagggccccttttgtcagtttagttaggtcaatattatacccacctctctatttgaacttgtctacatgaactgtctctatgaatttcagtaaagtggtaacatgaactctaatgtttgttggacttaaccttttaggagcaatacggaacactattaaatgtttatttactcatgtataggagataaaagatagtgaattcttagcaggcttcaaactaacttttgagcttgaaggtacttatcaaaacttataaatgataaaggaaataaaaaaagtgctatcaaggtggatttttaaaacaatttacattttgcttatcattttgatcttcctcttatgatctatacatttgaaaaataaatacgtctatattattgcccaggttttgaaataagcccagttactaataatgccacaagctaagactgagtctactgttaccataaagccagattagcaatccaagggcctggggaacttccgcttttttagcgcttttcctctggtgggtttgttcttgcatttgaacaaagctatgggtttacatgagtaattgcctaagtatctggacttgccgggtatcactgacaacaggcccaaattataattaactcaaagtaccgtgttaactttttcagccaaaaatacatagaccataagatattaggctttctggaagagtctaagttattggctctggcagcaaaagagtaacatattaactgaagagtaaagacaaagcttcagacaaaggttctctataaataattgtgtcaagatgtcattacatcagtggaatgtagctcaattaacaatatcttttaaaggacatcaccttgccctaccaagagaaggtagctgttaaattgtggctccagcttgaggtttgataatgtggcagctataggatccatttcctgttctagttgtgtatattgtggtaataagaaaagcaacagagccccaccataaccaaatacttttaaaaatacaaccttaccctaagaaattaagtaaaaacaaatcttattcctctggtcagtgttgaagaaaaaaacaaacattcgacttcgactggttgcctcacagggggagaaaaataatagtgcataaaagcaaagcaaaacaaacaaaaaaccttagtgagcctagctgacttgttctcaagaacacagaggaacatggaggagaggcaaggctgttgcctagttctaaattaattaattataaagaattacccccaattaaacactaactcactgcactttttttgtagattccttgtttttcccccccacatcatactgaatccaccaaaattatcatcaaaattttaaagcttgataaattattttgtctatccacttcaaatgattatacatcagacaagatccctaacgacatatcagaatgaattacatatctggatatgaaagaactaggatgtctaatttaaggcaaaggtggagtttgcaatattttagtgagaggattgagaagtatggctaaataggaattaaagtcagcataatccttacattaacggaattttattaaaattgtaccatgttatgagtagcagaaagtatttggaaagctgtttccatgtttacctttagtgtagtagataaaggctatctcaaataaaatgttcagtctaaaatgacggcacattttttcttacaatgattaattttagaaaaatctataatccaatttactgcttgaatttacatggttgcatataaatgatgtgactcctggtgtgaattaggtggcaaattagaaaagggctttttatttttattgttttttagtgagaaagcaggtatcaatataactcagagaaatattccctacatcttagagtgagattaataaatatgtctttgttatcaataaaatgggaatataattctatctctttgtattgttataaagattaagttgaaaaaattatgggaagtccatagtataaaactgagtaccctcaaaaaattactctacaaattattgtttatttctatattattttatcatgtatcaatacatattacattttcaaaaatataaaaatacctcattcttggaaaaaaatgaacatttaagagagacaatatgtcactttctcttcagcaatgtcaagagaaaggaaattttaaacagaaaactgcagatgtctattcctgtaacacaagtggatgcattgatctagcaaaatgagatgaacccaaaccattataagcaataaactcacttcattcacttggattctaatcacatctttagaattgaaatttggcttccaacttccatgttcctacaaggagaaaatgtaccacctaatattcaaacattccaacacctttcctttgtcaattatatttcttttattataaatcaacaaatttgcatgttgtcacatagttgtcttgcatgggtttggttactgtgatcccttctcctgactccaatcacatccagctatggagacaaatataaatttcttgatctgtgaatcaacctctggtccttgatttccccagacaagtatttctacccactgaggcctgaccttaacagccagccagtctctttagacagcaattatagccagtctgtttctaactattgcactgtatttataggttgaaactttttaagtagaaactagatatcaacagggctgcctagggtatttctgaatgatgaagacaatgaggatgatgatgatgtcaacaatgggagagaaaattgtctggaaagagcatgctgttactttctggaattatgaaaatattttattccttgtttggggtggtatttacctagctgtttgcaattgtgaaaactcatgaaattaaaaacttaatttctcgtgttttcttttatgcagattatatctcaatatgttcaggcagtagaaataactatgagatttcttcttcttaaataaaatggaaggccaggcgcggtggctcatgcctgtaatcccagcactttgggaggccaaggcaggtggatcacttgaggttgggagtttgagaccagcctgaccaacctggagaaaccccatctctactaaaagtacaaaattagccaggtgtggtgatgcatgcctgtaatcccagctacttgggaggctgaggcagtagaatcgtttgaaactgggaagcggagtttgcagcgagctgagatcgtgccatttcactccagcctgggcaacaagagtgaaatttcatctcaataaataaatacatacatacatacataaaatggattgtgaagatttgaatatggactattcaatttgtggtataattttttgtcatatttgaagaattttcttcacagagaagctttaggtttacaaaaaaaatgggaggaaggtatagatattttccatatactcctgtccccacccatgcataacttgtattatcagcatcccccaccaacgtggtacacttgttacagttgatgaaacttcatttacacatcattatcactcaaatactagtttatattagggtttattctttgtgttttacactctgtggctttgactaaatgtataatgagatgtttctatcattatagtatcatacagacttattttcactgaccaaaaaatcctctgttctctgccgattcatttttccctgaccacaaccccctgacaatcactggtgttttcactttctctatagttctgcctttcacagaatgtcaaataggtgaaatcatagcgtatacagccttgtcatattgcctttttccatttggtattttgaatttacagtttgttcatgtcttttcaaggcttgatagtacacttacttttagcactgaataatagtccattgtctgaaggtaccacagtttatttatccattcacttactgtagaccctcttggttgttccctcccaagttttgaaaattgtgaataaagatgctgtaaacatctatgtgcagatggatgttttcagcttctttgggtaaataccaaggagaatgaccgctggattttatagtaaaagcatctttagttttgtaagaaactttcagattgtcttccaaaggcactgtgtcattttgcagtccccagcaatggatgggacttcttcttgctccacatgttcaacagcatttggtgtcatcagggtttagaattttggtcattctaataggtgtgtagtgttatctcattattatttaaatttatatccccttgataacatctgatgtgggacatcttttcatgtgcttatttgctctctgtatatcttctttggttaggtgactgttacggtttttggcccatttttaaaatgagtggtttgttttcttattgttaacttttaacagatctttgtatattttgcatagcagtccttaatcagatgtgtcttttgtgagtattttctcccagtttgtagcttgtcttctcattcatttgacactgtctttctcagggaagaagtttttaatttcaatgaaggtcagattatcaatctttaaatgaatcctacttttgatgttgtatccaaaaagtcattgccatactcaaggtcacctaagtataattgtttttaatagaaatcatatttttgaaaaagaaatatagttaaattatatcatttcacattttttatcaatgcttttagctcttccaaaccattatgaaatagttgtatttttattgtgttataaaatcaaatcataattaagcttttcaaatgcaaagctaaaaaatgaaatagcataaccttttgaatcgaattgaatagttcaagatctctatgctctatgttcaagcattatgttaaaactgctgtcttactatctacagaattttctaattagcctaaagagatttttataatttacctataaatatattttgagagggagtgataataaaatcaaaataggtcaagatatccaagtaactttattgagatgtcaagtggcatccagcagaaggtgaagaagtcacagagttacatcatagaaggccttcctgctgtgctatttccttcaacagaaaaagaagctttcatcctctaaggcttccagcatctgctgaaactactttgagtaattcaatcttgtaaaaattatttctgctacgtatacttatctaacacataagtatacttataaaaaaataaaaccttgggcccacttgagaaactaaattatatttagtaaggagatcaattttgcacaccttggcttattgtgctctatttaaaaacatattttcaaaacgtagctcttttttttccctgtcatacacttggcttcagtcattttgctgtaattaaacatgataagtacttccccatgttagtaaggcctgtgaatttccttctgcttgaaatggctcatcttccagatgcctacatggcacaaggcctcctttagttcctgtctctactcatgcactgcatcactttctccaagaaatctacttcaccactgtctaaaatagcccaccacgcattccctcacatcttatcccctccctttttgtacataatacatatcactacctgatatattacatcttcatttgtttattcaaaaaatggactttgtagacttttaaaaaactgtaaaatatagtcttcaacaaatagtatgctttgtttctattttattgtggtataatttacattcagtgaattgcactgatcttaaatattactgttcaacagttttgatgaatggctacaccagtgaaacctgctatactgagaggacaaagagcacatatacttctcttccccaaccactatctaccccaccctttccataaaggaatacaggtagcctgatttatttcactattgtttacctgttacagaacttcatataaatgaaataatacagtatatcaagtttatgctacatgtatattatctaatggtacctttttctattttaaatatatagaatagcaaatatgagaatatttttaaactcatcatcatcattctaaattgtaaactcaatcatcaataaaaattaagatcttagtaaacctcacaaaccattttgtaaaaaatttttgattgccattttgtagtctgtaatatatgatttatttttgaaatgtgggaaacagattcaaaacctagtttcaaggaataatctataaaaattgctctaatataattttaaattatttattttggaacaatcataatgttttcagagaccatagaattttagcacaatatcctgatatttaaaaaataaaagaaaaaaagcaaaacccaagaaattaaaaaactacatatgctaatacagagtcaatatatacttggatagtttgttattactattgaactttttataaaattaaagtatatatatgaaaacagagaatttactaaaaactatactgtgaagaaaatatgtaaagcaatattcttgcacaataggccattcaattatcggtgggttttaatctcattttttatttgatcatgcttattgcttaatggtcatagaaatgttcctttatcaattttcatgggaaagttttgcagcagagaagttccctagaatcaacatgtcttagatgtttgtaaaataagtgatttctttttccaaaatgttaaaatcattagtacacaaaagtcattactacgttaatttattttaaagtgttccatttcagtaagcaggtattaaggaagttggtgttgggataagataattgtgccaaagtaaattcttaatggagttcataagagaggaaatacagtaactgttctactccaaggttggctttgggggatttttcaaaccaacttaaaagtcttggatgttatatctgactggaaattatttctactccctgagaatgaacaacatgctggcaacagtgaaataaggaagcttgaaaaagggaatgagttattctatgaaacagtctgtcctatacatcaagattcttttagtttctcactcaagactttaagatacacaaaaatcttgccgcaagatttctcgtaggtggtgtgacctcagtatacgttgaagtcagagattacattgggttctaacaactcagggtttttagataagatctaaagttaaaagctataaatcagacctctagaggagggctacattggtccaaattttcatgaggaatagactctctttgccaatacaattaggggtgtgtgtgtgtgtgtgtctgtgtgtgtgtgtgtttgtgtgaatgcgtttatctcactgtctcgggagtatgtaattgtgtgataggtggaaattcataaggagaatggatcaactacaagtggtcatgggtagtgccatgtggaaccatactggagcctaaggcaaaaggaaagtgtctggctatatacgtgacttcctgtgctttttaatggttatttttctcagaacacaaaaatagttttaaaaaataatgaaaacctggaaagtagagtattgaaacatacaatctagtttttaggtttaaatatctcatttatacctaaacctgaatatattataatattttcaaaatgtactcttttgcttactcatttttaattgagagaattgctatgtttgacaatttctcttgacaaatgtcttgattaacttttacttaatttcaacttactgatcctttcttttagattttgataaactatttcttgtgggattttcacattggatttctattttttaaatattgcattggaatatatttattctattattaagttgtgttggcattccttaaattctgcacccgaagaaagtgcttcacttgtgtccattttttttcctttcttttttgagatggagtctctctctgttgccaggctggagtgcagtggcgtgatctcctctcactgcaacctcggcctccaggattcaagcaattctcctgcctcagcctcctgagtagctgggatgcaggcatgtgccaccacgcctggctatttttttttttcttttttttttgtatttttagtagagacggagtttcaccctgttgctcaggctggtcttgagctcctggcctcacgattcacctgcctccgcctcccaaagtgctgggattacaggtgtgagccactgtgcccggcctcacttgcatcattctagttgcagccctgatgatgaattcttaggtttgaccttggattgtgtgtatccaaagtgaggcaaaagccaccagaaatgagatcaaagaactgagagcccaatgccctaaaacagactttccatgtagacagcaaatgcacaacgattataagaggaactgatgtagagtggagggcctcgagccagaaatttgaacgaggagaaactactggcaagacaggagatgcaagcaacaacaaagttttggggtacctggggcttaaaagagcagagatcttggcaaatgagaagataccagtcccaccctcttgctctgaggtgctgaagtacgagacaatagacaaaatttgaaaaaaaaaaaaaaaaaaaaaaaaagctgcaaagaaatggtttcctggaggaaagcatgaatgtcttaaatataatgggctttctgttcagtatttcagtatctggtaaatctcatcattagaagcaatgcagaaaattaatatattaccttcacaataccctcattagaacacaattataacaaccgaaaaggcaatgtactaacccatgaggactcacttaactcattacaatggtttagtgagctatattgagcttaaaacatatgctggaatggaaataaaaaaatgaaaaccctgaaaaataagctcttcagaggtttagaaatgaaatgggagtgatgaatagctaggagcaaggacatgggagtatacatggtgccaagagagaaggtatcattttactaaacacatacttcacctttttcacatttcatctaattttagcagcttaaaaaaagcttttgtttttagcttagacagaaactcttaggctttggacccatgttccaattctatacatcaaaaattgtgaaaatttctagagggaatgatggcaggacttctcagaaggttggaaaatggagggtgtgagttgaagaacagtggttaatgacaaaaattgtagatgaggtccacctgatcacaaatcatttctaaaaccatatttggggatttggataatttatttgcactcctaaacctctgtttcttcatcaataactgggcataatgatactactcaggtttcttatgagaattagatgacgaaataccgtgtttgtcatgtaggaaggtataataaattttacacctgcctacatgacatatatggtataattaatttataattaataacttgacttttataactaatttactgacaattacttattgagtacctgctatgtgttagggtaaagcaattcaagaacctaactgaactcctgatatttgtggcttttacattctagcaggtgtgccataatgagtgatattatttataacatcaaacgctaggagaatcacaaagagctgactccaccttgagtttgccttctagaaacagaaaaatagcatgaatcctaattttcacaaagtagatgaagatattcaatttgatactttaagaactttccaaatgaactaatttgaaaggaaaacgaaaagagaggattgaaagaattgtcattccctgttcaaatatttaatcttgtcaagttctctttaaatttgagtggaggcaaattcctgaagatcaagcacctggcctatgaaaatgtattaaatatgttttgatgataatttcagtgatcatagaaggcatttccaaatggaatccattacactgcttcaagtattattacaatgagttctagttctttcactaggttaatagattaataagttttattatcttgcttgtagaaagcattgaaaattcccaaggaagaaaaaataagttcaaacaagtaaccagaaaaataaaagagaaaaaggataattcacttctctattgtaatttatgtgtttcttgtatgtgggattagacccagcaaagctaaaagaggcaactaaaagctcagccccagtgctaattttgtatccttgaggaaatcacataccctttcaagttttaattattcatctgcaaatccaagattataaaatgacctcatattctagttgacaatgtttttatatcaatattttatttctttactttttcctcatactgtgccttgcttctcctttatatgtaaagtttacatatcaatttatacatgcgtatatataatttttctatcaatttcaggagtggataaaggatgtctttgacccaaattcttgccaaatctccttccaagagaagtattgcctattatactccaaatgtacaataccatagcattagtttagtaaaaaacaatatgtcttgtttctcctttatttttcttgatgttttcataattttaataaaaaacacttaaccaaagtgctgaggctgtgtttacaataaggtatttttaaattttatctctcctctaccaacacatacacataaatttaggaggaaaataagattaggtagcatcaatttggtgctaatgaaaatgaaaccagcattgatattttctaaatctaataatgcatgcattttgaatagttttctttgactcatttcccctgaaggtgaattcagattctttaggcattttcccaaaaataatttttaactctctgccttgtagtgaaattttccaaattgaaaagccatgtagaatacactgcgaacaattttacagccttcattaatatataagtcaatgtctaggtcacagcttctattaggtagccttatctttatcgatagttttccccaacttcagattctggtaattgcatgacttaccctaccctctctgtgtttaaatcctagattaaaggaggaaaacagcgtcctgtgaacactagcctcaggtgctgacagcatcatcctttgtagcagtccctgcaccttatccttacttagtaaataatcctttatttaaaaaaaatttgtttgagttcattgtagattctggatattagccctttgtcagatgagtaggttgtgaaaattttctcccattgtgtaggttgcctgttcactctgatggtagtttcttttgctttgcagaagctctttagtttaattagatctcatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgtcaaagatcagatagttgtagatatgtggcgttatttctgagggctctgttctgttccattgatctatatctctgttttggtaccggtaccatgctgttttggttactgtagccttgtattatagtttgaagtcaggtagtgtgatgcctccagctttgttcttttggcttaggacatgaacagacacttctcaaaagaagacatttatgcagccaaaaaacacgtgaaaaaatgctcatcatcactggccatcagagaaatgcaaatcaaaaccacaatgagataccatctcacaccatttagaatggcaatcattaaaaagtcaggaaactacaggtgctggagaggatgtggagaaataggaacacttttacactgttggtgggactgtaaactagttcaaccattgtggaagtcagtgtggcgattcctcaggggtctagaactagaaataccatttgactcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaactgtggcacatatacaccatggaatactatgcagccataaaaaatgatgagttcatgtcctttgtagggacatggatgatattggaaaacatcattctcagtaaactatcgcaagaacaaaaaaccaagcaccacatattctcactcataggtgggaattgaacaatgagatcacatgcacacaggaaagggaatatcacactctggggactgttgtggggtggggggaggggggagggatagcattgggagatatacctaatgctagatgacgagttagtgggtgcagtgcaccagcatggcacgtgtatacatatgtaactaacctgcacaatgtacacatgtaccctaaaacttaaagtataataaaaaaaaaaactgaaattggcctgttttattatttctcgtcagttctttgatttaataaaccagataaaatctcattataactaattcctaatattagccaagttattttattaaaaataactaagacagaaaaaaattggcttcaatatttggttataattttagaatatgagattacaaagaaattgtattgtactcatgatgttggtagcagggtttaacaatatatcttgggaaataaaatatttccatctatatcagaatgatatctagatgcttgtgtttctcttaatcttttaaagcttctttttaaatgtcttgttctactgggcttactctacagtgcaggtagatatattgaaaattcctaatttttcaatatatgaaagaaaaaagcaaagaaaagaaatatcagaacaaaacaggtatttagtaataaacaagtcaactgctttcttaaaactagagttgtaaattagttctcagacacttccacataagagtcacatgacacttactaattttaacagaaggctagccctgaagcagtgacacatgtttttgtgccatatttaattccacacaacattgattttaatgggaattgctagggagtaactacagttttgcccatggtcatcaaagtcactacaacatgtcttcaggaactatatagtcaattcatcgccctggccaatggccaatttgtaagttagatacatatcttttaccttgttattaaacaaacaaacaaacaaacaaacaagctctattcttctaagtgagttggttacatttaaattatcatttatctatgtatgtacgtatgtatccatctatctatctatctacctacctatctatctatatcttttgctgatgtagaactgctgcttttccagttgtatccaagtaaagttccatatcaatgcaatgatcccttttgtacagttattaagtataagttttctataaaaattagcattggatatgtagactactcatgtagttagcgatttaagttaagaccagacttggagaaataaatattaagtcagaatgaaaatcactgatcagctgacatcctcctttaaaagtgagaatatttcccacagaatactaatcatttaaagacaacttgctgtaaatgaaagacaaagatgaataaagccaaacactggtatgctgcagggcaagatctttgtatatattctatccggtatttgtttttgaaaattatctttattcatgtcatgaaattatcaaagaaaagagtgataaaggatctctgggttatgacagcacttctcctgcgatttttttaaatgtaaggaattcagtcagactcagtcagtctaaaaagatgcaaattcttgggaattgtatccagatcagataaaacgttggacactggttaacacagtatggtccacgtcactgactctcacagttacagtgtagtaatacatcagattatttgccaaaaatgtccagtgatgtttgttccattagtactcaaagtaaaagagtgcatctattctctcaagtaatattgaatgtacagtgtgtttcagacatttgtgaaaaaaatacattggtagttccgctcttgaggagtacgcaatctgttaaagaccaccaagttatttttttttactggaagtctttatgcaaagatagagaaaaatgtctacattgatggctgaacacctaggggattgaggtgtagtgaagataaaagaagagcacagaatgtatacctgaaagacctgaagaaaattttaatttcttttttttttttgagacagtctcactctgtccccaggctggagtgcagtgacgcgatctcggctcactgcaacctctgcctactgggttcaagtgattctcctgcctcagccccctgagtagcagggactataggcgtgcaccaccacgcccagctaatttttttttttttttgtaatttttagtagagacggggtttcaccatattggccaggatagtctcgatctcctgaccttacaatacacccgcctcggcctcccaaagtgctgggattacaggcgtgagccaccgctcccggctgaaaattttaatttcttgacccatattcttcagttccctctaaactatgctttcaagaataatgtaaatgcaagttaaaaatgtagtgtccaactgttctcacattaagaaatcagggttacatttggtgagaatacaaaaaaggaaaaaaaaataagtcaagattaattgatcatattaatttcatggtatcactccacgaaaatccagaataattaaattaaaaacaaaagttcaaggcaaagcattgctacaaaaatttcttataataattaatttactggttatgccccttacaggagtcaggaaacaggttagattccttacccagtgtgcccactaatagtccctttataaaaccatctcctggaggcactagtcctccctcagaagaacagtaggtgaaggagttctctggtttctggccttgaggccagttcctgtttaagcctaaataaatgaataaataaataaataaataaataaataaataaataaataaatattcctcttccaagaggcatctggcagttccccttatccctgatgagtccttcttaagaccatgtcgaattaagttaaatgaatcgaaagtaaattaggattaaattgtataacattgattcatacattgccttggatgatttatatacatttggaaagtttaatactttatcacaatggttaagttttaatgcaaaataaaattatctatgtagtgttttaaaatgttgattagcctactccttagcctttttgaagtactttttaaatttctggtgtaaattctggcatgtagttctttaaaaaaatcctgcaggaagtttttgtgcctttcaaagtttgagggcccctaatcttgggcatacaaatcagtctttcttctgattaatgtggcattgtccatcatttttataaatatgagtctcaaacccttgattgataaagaaaatgctcattataacattgtgacatttggaaaaatttaatattttgtatttttaatataaattaattctttcagaactattaaccttataggaaaacactagagagaatgattttagcagatttttgtaagaactcatctcctaaggtttaagaaatacctacatggtttaaaatagtaattataaacatagtaattttaaaataagatactattttgtttaggtcttccaagtcagttagctggtgtcagttttatggtcagaatgacaaaaatatataataaaaatgtgcagctcatttagctgttgaaggctaatgaacaattaaagcattccataagaacttaatctcacccattttttagtcctatttaaatctgctcctcctttccacaaagttcgaatggcataaattatttaagtcatatacaaagggaacccaatcaggctggcagaagacttctcagtagaaatcttgcaagccagaagggattaggggcttattttcaacactctaaaagaacttaaactaataatttcatattcctccaaacttagctttgtaaggaagggataaataaagtattttctagacaagcaactgacaagggaatttgtaatcactagaccagctttacaaggcaacctcagcggagtcctaaacatggaaaaaaaggacaatttctgccaccacgagaacacaattaaatacatagtctgcagaccctataaagcaaccatataatagaaactacaaagcaaccagctagcaatttcacaatgggatcaaaacctcacatataaatattaaccttgaatttacatggtccaaacaccccacttagaaggcacagacttgcaagttgtataaaacacaaagactcatccatctgctgtcttcaagagacagaactcccatgtaacaacacccatagttcaaggtaaagggttggagaaagatgtatcatgcaaatgaaaaacaaaaaagaacaacagtcacttgtgttagataagacagaatttaaaccaataataataaaaaaggataaagaatgtcattaaataatgacaaagggttcaactcaacaagtagacttaactatcttaaatatgcacacactcaatattggagcacccaattcataaaacaaatacttcaaaacctataaaaagacttaggcacaaaacaataatgggagacctcaacacatcaatgacagcattagagagatcatcaatgcaaaataacaaaataatcctggacttaaatttgacacttcaccagttggacctagtagacgttacagagcactctacccatcaaccacagaatatacattcctctcatctgcacacagaacatactctaagggtgaccacatgctcagccataaagcaagtctcaataaacacaaaaaattaaaatcatatcaaccatactcttgaaccacagtagattaaaaccagaaaccaatactaagaacatctcccaaaaccacacaatgacatgcaaattaaacaacttgctcctgaaggactttcagataaacaacgatattaaggaaatttataaaattatttaaaatgaagacacacaacatttcaaaatctctgagatgcagcctatacaatgttaagaggaacatttacagcactaagtgtctacatcaagaagttagaaagatctcaaattaatgatctaacattacacctatgggaaccggaggaaaaggaacaatctaaacctaaagctaatgagaggaaagaaataactaaaatcagagcagaactgaatgaagtagagacccaataatccatacaaaagatcaacaagaccaaaagttgggactttgaaagcataaacaagagagataaacctccagctagatgaacaaaacaaaaaagagaagatccaaataagcccattcagaaacaaggatgacattacagccaaacacatggaaaccgaaaagatcctgagaatattatgaacactggatgcacacgaactaaaaaatctagaggaaattgatacattcatgaaaacatacaacctccccaaattgaatcacaaagaaattgcaactctgaacaaatgaatcagtcataaaaaaccctatgaatcaactaatgtccctgaccaggtggacataattcacagccaaattatagcagaaatacaaagaagtcctactaccaattctactgacactattacaaaaaattaaggaggaactcctctgtaactcattctatgaagccagcatcaccctgataccaaaacctggcagataaacaatgaaaaaaagaaaaactacaggctaatatccatgatgaacataaacacaaaaatctccaaccaaacactagcaaacctgatccaacagcacatcaaatagctataccatgatcaagtagcctttatttctgggatgcaagagtagttcaacatgtgcaaatcaataatgtgattcaccacataaacaaaattaaaaacaaaaaccatgtaattatgatcatctccatagatgcagagaaagcttttgataaaatctaacatctcttcatgataaaaatacttaaaaaatgagtcaccaaaggaacatacctaaaaataataagagtcatctatgacaaacctatagccaacatcatactgaatgggcaaaagcgggatcaatcccttgagaactggaacaaagcaaggatgctcactttcactacttctattcaatgcagtactggaaatcttagagcaatcaaagaagagaaagtaataaaagacatccagatatgaaaagcagtcaaactatttctctttgctgactatatgtttctacactaaggaaacctcaaagactctgctgaaaggctcctgaaatggataaatgacttcagtaaagtttcagaataaaaattcaacatacaaaaatcagtagcatttctataatgttcaagtggagagtcaaatcaagaacacaatcacatttacaatacccacaataaaaattaaatgtctatgaatacatccaacaaagaggtgaaagatctctgtaataactacacaatattgctgaaagaaataatagatgacacacacaattataaattcattccacactcatggaaggtaagaatgagtattactcatggtcatactgcccaaagcaatttacagattcaatgctattcctgtaaaactaccaatgccatttttaacagaaatagaaaaataggattctaaaatatagaacaaaaaatagcctgaatagctaaaggaaggtaaacaaaaagaaaaaagccagaggcatcatattatccgacttcagctatacaataagtctacaatatccaaaataggacggtattaatacaaaaacagacacatagacgtatggaacagaaaagagaacccagaaggaaagctgcacacctataatcatacgatctgtgacaaagttgacaaaagtgaacgctgggtaatgttcaatatatggtactcaaaaactggctagccatatgcagaagaatgaaactggactcctacctttcaccatataataaattcactcaattcactcaagatggattaaagatttaaatgtaatacttcaaactataaaaaccctagaaaaaaacccaagcaacatcatttttgacattaggctaggaaaacaatttatggctaaatcctcaaaatcaattgcaacaaaagcaaaaattgacaattgggacctatttaaattaaagagtttgcacagcaatataaaaaaattttaaaaagatcaacagagtaaatagataacctgcagaatgggagaaaatatttgtgaattctgcatctgacagaggtctaatacccagaatctataaaaaacttaaacaaatttacaagaaaaaaataaccctattaaaaagtgggcaaaggacatgaagaggtacttctcaaaagaagacatacaaacagccaacaaacaaatgacaaaatattccataaagattgttaagttccattggatcgcatgataatttcattgaatctgtgactggtaaaatttacagcttcagtaacaccagatgtaaaatgaagaatctatatgttggtcaggttataatcaagacattatttttcttgtcataattacacatactcttttatcatgtattttcttgaggaaatacatatatgcaaacaaaacggtaggtgctcttattttctttttaaacaatacaatatgaaatataaatgtacactagatgccacccaatttaagaaatagaacattactggcaaggtgtggtgtctcactcccgtaatcacaacactttgggaggctaaggctggaggattgcttgaggccaagagttcaactagcatgggcaatgtagggaggccctgtctctacgaagaaaattaaaaaatatagctgggaatggtggtgcacacctctcggcaggaggatcacatgagcccagaagttcaaggttacagtaagctatgattttgccactgcactctaggcaatagagcaagaacctgtttccaaaaaaataaaaataatgaaaatatttgatctaaagaaaggaatataccatgttttcctttatttagcatattaataaaaacaataaagatacacatatttcagttactggtatcttagaatatcttgcatatatacaatctgagctttttgatcaggaaaaaaatttaaaagaatctcttgcataccttttcttacactatcctgaattttgcgttattacttgccatagttgatagacagactataatgtatgcacccctaaacagtatatagtttttccttttttaactttatgaaaataaaattatacccttgaatttatacccaaaaattctcatatgaaatattttatccatgcaattaacaaatttaatccaatggctataaaatatagactattataccaaacaattgaggaattagaatgattctataatgtcttttatttacttgtgctacttggataattgttattttcctccattttattttactaagtggagggctggtttatgttaccttttcatggagaggacaaaattaaaggtatctcaaggcaagactaggtgtgggcctgtagacaacactaaaatgaatataaggagagagatatgctagtaagggataccacaatgggcaaatgcttttatttttgacctatggatgggaagggatacacagacctgtagggttaatggtatccaaacacatagaaattctaacatacaagcattcagtagataagattatcaactcccaatttctactaaaaaaaagttcatatgctaatcaaccatatcagttgcttcaattataaacctcatttacaagtcttaatagaaaaggaattgatttttttctgctttcaaagagaaaatgagtgaaaatagacaccctctaaagcatattcaacacctacccaacaaactttcaaaggtagatctatttagctaccaccatttacttgaagttaaaatggtacacaaaaatctattgcctaaatggtagtcttcattttatcatttaaaattaagattcgactaaaagatcaatagaaaaatatttgatctaaagaaagaaatataccatgttttcttttatttagtatattaataaaaacaataaagatacacatgcttcagaatggaaagaaaggtgtttacttttaacggcagaacatatcaatcacctcattattacataatatattatttaaggtcaagtgtagatgctcaagcttgtaatcccaaagctttgggaagctgaggagaatgacttgagctcaggaatttgagaccactctgggcaacataacaagaccccatctctataaaaaggaaaacaatgaaaataaaattagtcatgtgtggtagtgcccacctgtagtcctagacccttgagagactgaggcagaaggatcacttggatgcagggttttgagtctgcaaggctgcagtgagctataatcatgccactgtactcaggcctaggtgacagagcaagaccctgactttttaaaggaactgtatttgcttctattaaacaggtcacaaacactctcaatagttttttttctcaaagttgagatatatggaacaagtttttaaaatttcaccatattgataaaattatcccctaaatctatccagggtaatatattatccacaataacatattttcatatcttctttcttttactccttactggttttctactgcttcaataatttgtttttctctttattctatcttgattcatgtctagttcttgtttcctatgatatcctccttgtaattttaacccagttcatccctctaatcttccattcagtatctctctgctgtgtaggaagcataactgtgctgagttcttggctggaccactgaaatcaagtaatgactgaatataaatcagaatcatggctgtaaataaaaagaatgtgaccaaatgtccattagcaatgatagtctagtcatataaaaatgtggctattttcaattaataaaacaaaacaaggaagaaaaagtaaagacaatgtcaggaacgatgataagaataagcatgtaacaagcaaatggtaggtttgcttcaaccaaatggtaggtttgctttcattacatgaaaattttaccaaattgtacatataaagtcttctaagaacaatatacaaataacattttagtatataaattggctcaagaaagtcatttttcagggactctagatttataggctctttaagtctctttaaaactgtaaatgacccacagaagttggctgccctaaaggtttagattaaataaaccatccagtgcacaattcaaatataagctgaacaaccttaattggaatatctatcctgtgcggttttccagtttctgatttggtactccccaagtagcaatttcctatgaattaccgtttcccaactaagaggtacagaaattcccagtttctttaggaggctgaatattttaaaacttcggctttattaaggttttcaacaaagttctaattaaactacacttcattaatggcttacccccctaccttagaataaggagagctttcttacaattattaaagctaaccttcagaactgttgttaataacaagactaagaacaatttttaattttttttaacttcatagctgtaggctaaccaatagttaacaaataattcattcatttcattggcatcatcagtcctcctagcaatatgtgttttttttttttttaatttaagacttggtgggggaggcggtgaggactgtgcaattactagtcactgttttcccactcattggtactattagcttaacagataaaaccacagataacagccgcaatcaacttcagcaggttcccagaggcaagctcttgctttttgctgattagcttcattcaattatgtcttcttaattgttcatgtgctacagctcattaaatgaaaaataatattcctttcctgtgggtagggcacttgagatttgaaaaatagccacttcatctctgcctcagaggcacaagtaagttgatctgatggtgtctgaaaaagctcaacagatttgtgcagatagccctgcccgagaagggacaataaaattaataaaattgattgttaaatcaagtcaaaaataaaattactcccagtattttcctttaagattaattttcaggaaaattagacccagttttgtagcatttgattatgttcacctctgtaatataattttctttgtaaaaagatcagttattgctgttccattacagatgggatttagggaaagtggagtaaatttttaaatttttctgaaaatagattttgacagattaaaaagtgtgtcacacaatttatttatgaaatattctagaaatggagaaggtaagtttcattcattaaaatagattcattgagtacctactatgttccaggccttttgctacacaatgaggatacaaaaggtcttaacttcaagaggtttattagtctggtggagtagaaataataattcaataataatccattagctaatatatactggctatttactaaggacctataaagtacttggtcgatatgtgtcaccttacttaatctttttaacgatcttataacatagaccatatcatattttttattatagatgaactaaggcttagaaaaattatattgcttcctgatatcacataactagcaaatgctaaagtttagtttgggacaagatatgtatgaccttgtagcattcctatttacaggtactcctcaatttacagttcctatatgcatacatttcagtcaccatgtttagttaagttagaccagttacccagctcaagcgattctcccacctcatccttctaaagtgctgggattacaggcatgagccaccacacctggacggatgtgccatagtttgtaaaagagttgagaatggctgctagctagtagaaaaaaatggtgatattagaaacatgggtatattttcaaatgaattccaaaagtttgagaaagtaatagaatttttgtctgttttgttctctgttatttcgcaaacacagatactcagtacatatttttgcttttttttaaggagatgaaaaagtctgacatgattttataaaaaataaaatttcaaatttcagctaccacagtgtattaactgtaagtaattacataagtacaaattttgctccttgctctttggtccaaaatcattatgtaaataacaggtgtgcttcatgatcagtgaccattggcatcatctttttaaatgtctgtcagtgattgatcactacacatctattattcatcacatgcagacagaaaagtgtgcagttatgttgtctctgtttcccattgataaacacaagtgccatttcttaaaaataaataattgaaagaattggccagaaaagataaaagtacaacataaagtaaaacgttgagtccagtgaaaatggagctacagcaaaatccctgtgggaatattgacactgctgccatctgaggaacttaagctttgcagccagaacaacttagtgcagaggagcttattgacataaatgaagaaagtggatgtgatgaaaaggatgaagatgtatcaggctaagtgacgccagcaaaaacccaaacacacaataaaaaaaaaaaagacttacattaaaggaacttacagagatacttaacaatattgaaagcatcaaagcataaagtgatgaaagctgatccaaatttaagattatgacaatttgccaaggcataaaacattgcccccttcattgtaagccatgtaagaagaaatcaatcactattcaaactattagtaaacattttttaacaaacaagtaaactttaagtctttaacatcaatgtaattaagagggaattggccagcatatgtgaaagtatagcaaacaaatgaaaataatgatgcaaaaaataataatgtaagatatgagttgaatataaacagagttatagaaagaaagaactgactttaattcttttattcccagtgtaaattccaggatgttaaatgaatatgttttataatttatttattttcctacacatttgtaagtgacagtaaaagagtttctaatattttgaaaagaaattaaaggttatggaataatatttattcttgattattaagataaacttgcatgatttcagctgagattatcatgtttatcatccttcactaccatgtaaagcgagaagtgtgggtattaacttattatctgtttgtttaaagtgaatgacacacagcttagtgttacatcaacagaaaaatatttaagaggaaatgacactaaatcaattttaagataatgcttctattatgtatgtttctgtatcgtctttctaaacataattatggaaaaggcatcccaactggtgacataattattgccaataatataatagtaatgacaatatatttgttggtcaattaaaagtaactacattagctttggtaaaactacatttttcacttacatgattaaagacacttatcagtgctcttgtgatcctactttaagatatacatcttcatattaatttgtaaatgaaatgtgggagtttttcataaccaacaggtttaaagctgtgtgaagatatgtgagggaaatatatagttatgtctgtaagaatcagtgatgtgccatactttgtgttttgttgttattgttttcttgagacaggatctcactctgttgcccagcctggagtgcagtggcatgatcacagctccatgcagcctctacttcccactcaagcgattttcccacttcagcctcccaagcagctgtgactacagttgcatgtgaccacacccagctaatttctattttttgtaaagacacggtctgactatgtggccggggctagtcttgaactcttgggctcaagcgattctcccacctcatccttcttaagtgctggtattataggcataagccaccacacctggactgatgtgccataatttgtaaaagagttgagaatggctgctagctagtggaaaaaaatggtgatattaaaaacatgggtatattttcaaatgaattccaaaagtttgagaaagtaatagaatttgtgtctgtcttgttctctgttatttcccaaacacagatactcagtacatatttttgcttttttttaaggagatgaaaaagtctgacatgattttataaaaaataattttgatgttagtaatcattactcaacatatttttgaagagtctaaaggaaatttccactgtttcaaaagatcccaccttccatttctctctatctcatctcctagcaatctacccttcatttattgtactctagttgtgcttatctttttggtctttatcaaacacaacaaatattctgagaccttaatatttctgttccctctccctggaacactattcctcaagaaataaaattaggtaattatttcaatcaagctggtatttaaacatcttctgctcaaggaggcctagctgataatctgtatttaatgttccagttttcctatactctctctgaacccccattggccattctattttgttttatccatagtgcctatcacctgttggcatattatatgaactctttgtttattaacttatttgttaattttattgtttatcatttatgtctatcaatggcatgtagactctaagagagcaggcatatttgtgtgtgttattcattgatatttcaagattaccaaacagtgtctgtcatatagcaaccattctttttttatttttttctgagacagagtcttgctcccgggttcacaccattctcccacctcagcctcccgagtagctgggactacaggtgcccaccacacccggctaatttttctatttttagtagagacgggctttcactatgttaaccagggtgatctcgatctcctgaccttgtgatctgcctgcctcagtctcccaaagtgctgggattacaggcatgagccactgtgcccggcccgttcattacgtaagaataaagaaatatccccttgacatgaaattctgtgtattggaataatatatataccatggcaatgagcatttgtcattatcttagtcagcagtatatattttcctagacaatgaaaagactcccaactggccttttgtatgacaaaaagaactgctaatcactttcccagtttggcttttatttatctccagattaaagtgttattaaggattaatttaatgttattttattccatttagtgaacttttaaacaataaaacacttttatctatgttgttttgcacccatatgacaataaagtgttatcatgcccatactataagtagaaaaacacaggtagaaagaacataactgatttgctcaaagtcatataactcagaagtgaccgaatacatttgcctgactccaaaacttggtctgattttatcatcccttgctggctgtcagatctgatatatcagtccaaaaattacctcttgcttaaaccgatgttttggatgacttttgtaattttctgcgttccatcatttattagcgccaatatataaatggttatttagaatacagaggtttacacatattcgggaccaacattccaaaaatggcttaaatatttctggcagcctaatattatctacggagaattattttcctcaagaacattagtgagatgtgctataataatggttgagcaaagtagcacaacactagatgctgtgtaactctgggaacaccttatttcctgctctgatagaaatctgttaaagaccctcatctgttacaggcagagagaagagcagagtaaaagtgctttgcctacctaaagggattgttgtaagaatctgatgagttaaactgtgtgaaagcattttgcaccctctaaatccatacatttacatgtgacttccctgtatgacacaagctaacaaacaaactagaaacaagcaaacaaaaaaaaaccgagacacaaaaataaaatatctttctgttacctcatttgggaaggggtctaaaaacccagaaataatagtatttacatgtacatgtagttggtaaacattcaatggagtaaaaagtaaattaaaaataataccattagcagaggggaatgtatttttacttatgcatatatacccacatattggatttgtctctatttcatctgtaggacctagccactagccaaatgcccgaagcccctagaaccccagtgcctagtgtggtatgcagaaaataatgccctgttatatgtccattacctaattccaagagccttggaatatgttaccttacctggtaaaaaggactttgtagatgtgtttaaagttaagaacctccatatggaaaaactgtcccaaattatctggatagacccaatctcatcacattagttttaaaaatattaaaccttccttggctgtggtcagggagagaaatgtgattgtagaagaatggcaggcaaatgtaacattgctagttttgaaaacaaaaggagtccagaagtcaagggacgtgggtggccactataagctagaaagatcgagaaaactgattctcccctagagcctccagaaagtagcattaccttgccaatttaacctgattttaatcgtcagacctgtgtcaagcatgtgacttagagaagtataagatattacatttgtgttgttttaaggcactaattttgtgataaattgctaagacagcagtagataactaatacagctagaaaacaattttaaaatacattttaaaaagaacttcaacatgccaatatctaatgaataaaaccaaaaataggatgaaaaattaaaatgaaacttagaatttttctatattacatatttgggaaatttgaattatttcataatattctgatctcaaaaatatgaaaaaagtagcttgtctagttatcattcacctgaaagcaactgttttaaacctgtcattacaatctgataaaaagtaatatgtctcattcagtcccaactacgctcaacatgacccaatcttgtcagaacccaatgtgaagcttcaagtgtacaggaatttacaatgacaatgctccatggaattttcaatgacaatcaatgttccaaaaaagctatgacctacacttgaggctatcccaaggagaagcaaatatcatagcagcatcttacatttgtgaacacagtggtaaatatagagcatacaaaaccatgcatgggtattttcttctgtttttaacaatggataatgaatgtcaaaagtgatattcaaactagcaatatgcaagttaaaattaaatccataaagcacagcaaaataagcatttgttccattgtagagctcacgtttccttgagcacttattttctttcttttccctcctctctgctcctgtcccctcccctccctccttcccttccttcctcctttcctttcttccttcgacttccttcctgacttccatttttcttttttcagctttattgaggtatagctgacaagtaaaaatgaacatatttaaggtgtgcaacttgatttttgtatatgcatacattgtgaaatgatcatcataatcaagctaattaacatatccatcacatccataatgtaaaacatatctaatgttgtacattagatatactgttaccatgctgtacaataggtatatgccacattttccttattcatttatctgtccatggacacttaagttgtatccataccatagctattgtatataaagctgaaatgaaaactaaagcaaatatcgattcaaaattattttatttcctttgaataaagactcagaagtgggattgctgaagcatttggtagttccatttttaattgttaaaggaatcttcatattgttttccataatggccacaccaatttacattcccatcaatatgtcttcctttttctccacttccttcacaaaatttatattttgaagtttgataatagccattcaaacaggaatgtggtgatacatttttgtggttttgatttgtatttcctgataattaatgtcattaatctttcatctttcatctacctattgacctgtcgtctttcatctagctgtttgccatttgtacatctttggattaatgtccatttttgtaaatttatttttctattgagttttgtgaactccttatatattttgaatattaccttttatcagatatacagttgcaaatattttctgtagtttgtcttttcagtctgttgattgtttcttttactgtgcagaagctttttagtttgatgcaattccacttctatacttttgtttttgttgcctgtgcttttgctctcatatccaaaaaaatcattgccagaaccaatgacaagaatctttttcctgatggctttttgctattagttttacagtttcaagtcttatgtttatgtctttaatccattttaagttaatttttatttttgtatgtggtaagagcttatcttcatttttctacatgtggatatccagttttctcagcaccatttattgaagaaaataccttttccccagtgtgtattcttggtgcccttattgtaggctggtttactctaagtgcatggatttatttctgggctctctgttttcttgcattaatctatatgtctgtttttatgcaaattccacactgttttgattagatttgtaaattattttgaaatcagaaagtgtgatgcctctagcttgcttttcttgctcataattggtttagctatttgctatttggagtttattgtggttccatataaattttagaattttttttcctatttctgtaaagaatgccattggaattttgacagggattgcatgaacctgttgattccttttggctagcatggctactaaaacaatattaattatttcaattcataaacatttattttccatggatgaatgttttttcatttatctatgctttaacatttttccttgattcctcctccaagatggccaactagatgcagccaggagaaacatctcccacagagggaccacgacatcaggaagacgggtgtacccctagtaaatcttcagagggaaggcattgagagcagatagagagaagatacagaaggtgggataaagggagatgaagctgggaatgctgcatgtggctaccacacaccaggactcattcctggctcccagcaactcctgtggaaggggtgagttgaacagaaatgagcaactcactctcaccatgagcctctggaatcatagcaggaggagtcttgtcagccaccatggacacttgagttggcagagaaagctacttagtgaagtggtagggacagaactccagctgcagcagagcccatggggtttggtgcaggagcatctatagtggagaacagccagggatgcccatccccctaggcttgatttgctcctatagtagacattagccctaaggaaaggggtgaacgtagactctgtagagcagtcttgcccatgagatgagccaggccccctgagcaccctttggtgtgctgtcttctctttgggccccagcctgcctgtacctgctagcagtgtacccccccaggcacctcaagggggcctgcctcattgctcctgcactggtggactgcagctgactgggagagtgctccagaagagcaaaccctgtgtatacatataagactgcccatgtcctccccacactacagcctcctccatactgctttgctggcaggcactcgctgccagcgatccccatacatctctttgcctgtacatgtgtttgcagacagacctagcctttccttctctgacagtgcatgtgtacacatgtaccatgccatgccatgccactattgctggcttgagtgtgccccatcccttctccccctgttgcactgccatttttgttggagcattggagggcatatagtttgacagctctgccaccaccagtgctccactcctgtgccaaaactgctggcatgaaactaagcacagaaaacagtgtatctactcccatccctgagaggtcactgctgtaagcaagaatgctcacagagggtgcacacagtcctgcgaccactagcgccccatccctgtgctaacaccagcaccagtacaaatgtgcacaccattgccagcagggccctccaccttcccaaaccataccgccacagccactactacaaacacccacatggaggctgtcatcttccatgtggatggaggatgccgctggtacatgcaaatgtggacacatcccactacgactgtcctacaaaatgctttggctgggagtagccattagagtgttgtgaccagcagtctgagatcacattgacccctccagtgcagcaggttcctaaacttgatccacaggtaatagctggtgtatgataccagtctcccagagttagagcacacaatgcagagtgctgagctgagccttggccacctgaagtcttccactaacaaagccaggtgactgaacacagcttataccataatcaaaccctcaaggtcataaaatagaataaaagaaaaaaaatccaaaggacagcaacttcaaagattgaaggaacaccagcccacaaagatgagaaagaaccagtgcaggaactctgacaactcaaaaagccagagtgccttctttcctccaaatgagcacactagccctccagcaagaattcctaatgaggcagaggtagctgaaatgacagaaatagcattcagattatggataggaataaaaatcattgagttttgggagaatgttgaaaccacatctaaggaagctaagaatcacaatattaagatacagaaggtaacagacaaaatagccagtacagaaaaacaaacaaacaaacaaacaaaaaacataaatgacaggatagagctgaaaaacactctacaagaatttcataatgcaattgtattaagagaagaataccaagctaaggaaagaatctcagagctcaaagactgtttttcttaaataagatggtcagacaagaataaagaaaaaagaataaaaaggaatgaagcaaacctccaggaaatataggaatatataaagagaccaatattatgactcattggtgtccccgaaagagatgagaagaaagaaagcaacttggaaaacataagtcaggatatcatccatgagaacttccccaacctaaccaccaatattcaaattcagaaaatgaagagaactcccacaaagtacttcacaagaagatcatccccaagatacataattatcaggttctgtaaggtcaaaatgaaagaaaaaaatgttaaaagtagctagagagaaaggacagatcacctacaaaaggaagcccatcagactaacagcagacctctcagtacaaatcctacaagtcagaagagatttgggacctatattcaataacctaaagagaagaaattccagccaaagaaatttatatttggctaaacaaagcttcctaagtgaagggaaatatgatccttttcagaaaagcaaatgctgagggattttattaccaccagacctgccttacaagagcttctggaagcattaatatggatgggaaagaccataaccagcaaccacacaaactcacttaaggacacagaccagtaacactataaagcaaccaaacaagtcagcataataagtcgacagcaacaggataacaagatcaaatacacattaatactaaccttgaatgtaaatgaactaattttcccaattaaaaggcacagaatgtaagctggataaagaaccaaaacacaattgtatgctgtctgcaagagacccatctgacatgcagtgatgcccacagaatcaaataaaggaatggaaaaaaatctgccatgcaaagagaacacagaaaaaaagcaattattgcaatcctaatttcagacaaaaaagattttaaaccaataaaaataagaaatggcaaagaagggcattatataatagaaaagggttcaattcaacaagacctaactagcctatatatacatgcacctaacacagaaacattcagatttataaaccaagttcttagggaccttcaaggagacttaggctactacacaataatacggggaaattttgacacccccactgacagtattagacagaccatttaagcagaaaattaacaaaaataatcagaacatgaacttaacactggaccaaattgagctgtgaaacagctacataactgttcatcaaaaaacaacataatgtacattcttctcatgtacacacaacacatattctaacaatgaccacacaatcaaacataaagcaatcctcagcaaatgcaaaagaaacgagatcataccaaccactctcttggacaacagcacaataaacatagaattgaagaacaagaaaatcagtcaaaaccatacaatcacatggaatttaacaacctgttcctgaatgacttttgggtaaataatgaaattaaggcagaaatcaagaagtattttgaaattagtgagaacaaagatataatataccagaatctctgggacacaattaaggcagtgttgagagggaaattcatagcactaaacacccccatcaaaaagttagaaagacctcaaattaacaacctaatatcatagttaaaaagctacagaagcaagagaaaaacaacaacaacaacaaaataacaacaaaaacaaacaaacaaaaaaacccaaagctagcagaagataaaaaatacaccaaatcagagctgaacagagactgagacataatacaaccattcaaaagatcaacgaagccaggagttgactttttgaaaacattaatacaatagatagaccactggttaaactaagaaagaagaaaacagagaagatccaaataaacagaatcataaatgagaaagggaatattaccactgaccccacaaaactacaaataaccatcagagactactatgaaatcctctatgaacacaaactagaaaatctagaataaatggataaattcctacacacatacagtcttccaagctgaaccaggaagaaattaaatccctgaagataactataacaaatgctgaaattgaatcagtaataaacagcctgcaaaccaaaaacagccctagaccagatgaattcacttctgaattctaccagatgtacaaagaagagttggtgcattcctactgaaacggttcccccacaattgagaagggacttctcctcaactcattctatgaggccagtatcatcctgataacaaaacctggcagagacacaacaaaaaagagaactttaggccaatatacttgatgaactttgatgcaaatatccttaacaaaatactacccagctgaatccagcactatatcacgaatccaccacaatcaatattctttatccctgggatgcaaggtttgttcaatatacaaaaaccaataaatatgatttataaaataaagagaactaaagacaaaagccacatgaacatctcaatagatgcagaaagacttttgaaaaaattctgcttcccttcatgttaaaaactctttacaaattaggtattgaaggaatatacctcaaaataataagagccatatattgcaaacccacagccaacatcagactgaatgggcaaaagctggaagcactgtccttgaaaaccagcaccaaaaaaatgatttctccacttgctatttctattcaacacagtattggaaattctgaccagagcaatcaggcaagagaaagaaataaaaggcatccaaataggaggagaggaagtcaaactaatcctgtttgcagatgaaatgattctatatctagaaaagcccagtttcagctcgaaagctctgtaagctgacaaacaacttcagcaaagtatcaaggtataaaaatcaatgtacaaaaatgactaccattgctatacatcaacaacagccaagctgagagccaaatcaggaatacaatcccattcacaattgccacaaaaagaataaaatacctaggaatacagctaaccagaaaggtgaaagatctctacaatgagaactataaaacactgctaaaagaaatcagagataacagaaataaatttaaaaaaaaattctatgctcatggataggaagattcaatatggttaaaatgaccatattgcccaaagcaatttgtacataaaatgttattcctatctaattagcaactacattattcctatccaattagcaattacattcttcacagaactagaaaaaaaatcaattttaaaattcatatggaaccaaaaacatagcccaaataatcaagggaatcttaagcacaaagaacaaagccggaggcatcatgctacctgacttcaaactatcctacagggctacagtaaccaaaacaacatggtattggtacaagaacatatgcatagaccaaaaaaacaaaacagagagtcaagaaataagtctgtacagctacaaccatctgctctttgagaaaactgacaaaaaataagtaatggggaaacaactccctattcaataaattgtgctgggataactggctagccatatgcagagattgaaactggaccctttccttacatcatatacaaaaatcaattcaaaatgtattaaatacttaaatgtaaaacccaaaactataaaagcactggaagacaacataggcaatactattctgaacataagatctgacaaagatttcatggaaaatatgccaaaagcaatcacagcaaaagcaaaaattgacaaactaattgaaaaactggtacactagtctccagtgaaagcaactgcacctgaagttaatggaaagaaagaaggggaaaaggaagaagaagaggaggtaaaagatgagggtgataagttagaccaagctgaagagggaggatctgagaaggaagcctctagtgaaaaagaggaaggtgagcagaaagaaggagaaacagaggctgaaggtgaagtagaggaagccaaagctaaagaggaaaagaaagttgaggaaaagagtgaggaagtggccactaaggaggagttggtggcagacaccaaggtggaaaagccagaaaaagccaagtctactgtgccaaaatcaccaaaggaagaggcaaagtcaaaagcagaagtggggaaaggtgaacagaaagaggaagaaaaggaaatcgaggaagctcccaaggaatagaaggtagagaaaaaggaagagaaaccaatggatgtgccagagaagaagaaagctgagtccctggtaaaggaggaagccatggaggaggcagtcaccattaccaaattggtaaaggtgcacttggagaaagagaccaaagaagagggaagccacagcaacaggagaaagaggagaaagtgggaggaaatggggaatgagaaggaagggagtgataaagattccaaggaatccaggaagaaagacatagctgtcaatggagaggtagaaggaaaagagaagggagagcaggagaccaaggcaaaaggcagtgggagggaagaggagtaagacattgtcaccaatgacctagacttaagcccagcagatgaaaagaagggggatgataaaaatgaagataaagtggtggtgaccaaaatagtagaaaaaatcaccagtgagagggagatggtgctaccaaatacatcactaaaactgtaaccatcactcaaatggtcgaagagcatgaagagacctttgaggagaaaccagtgtctactaaaaaggtagaaaatgtcacttcacatgccgtaataaaggaagtcacccagagtgactaagatttgagtccactgcaaaagtttaagccatacgacaatttcaaaatgcatgtgattgacagcttcaaaacagaacagattctcccataggggctccagacattgtattttactttgtgcaatatgaggagactgcatgcaagctcagtgtgctcccccctcagtctttgggggattcaaatgcatgatactgtatgtacctgggaaatttaccaatttcctgcactgttggaagggggtcactcagaaggggagatgtcttgagatgtattatgtaaagtaccaactgagccaaaaacaataaatgaaacacagaactctcttagccttaagaaagctatatatgaataattatgtttaccacactggtgcatttaaaatggacttttcttcatgggagaacctcgttgacacggacagtttgcaatcttatgttgatcgatgtgaaatgtcatagcagtacttgctcaataaaggtcatattggaaacatagtcaaaaaataaataaatgaaagagcttctgcacagcaaaggaaactatcaacaaagttaccagacaaccaatagaatgggagaaattatttgcagattatgtagctgacaaaggtcgattatctagcatctataaggaatttaaacaaatttacaggaaaaaaacaaacagccccactaaaaagggtgaaaagtatatgaacagacacttttcaaacacaaaaacaaaaaaatacttgcagccaaaaaaaagtattttaaaaaagctcaacatcactgatcattagagacacgcaaataaaaaccacaatagaaaacatctcacaccagtcagaaagctttttattaaaaagtcagaaagtagcatatgttggcctggttgtggagaagagggctcacttttacactgttggtgggagtataatttagttcgtccattgtaagaagcagtgtggtaactcctcaaagaaccaaaaacagaactgccatttgacccagcaatcccattactgggtatatagccaaaggaatatgattgatgtattataaagacacatgcccacatatgttcatttcagtaaatgtggtacatatgcaccacggaattctatgcagtcataaaaagaatgagaccatgtcctttgcggtaacatggatggagcaagagaccattattctatgcaaactaatacagggacagaaaaacagaaaacagaaatactgcatgttctcacttataagtgggagctaaatgatgaaaacacatggacacaaagacagcaacaaccagacagtgaggccaaccagaaggtggagggtaagagggagaggatctgaaaaaagtagttattagctactttgcttagtacacaggtgattaaacattctgaatatcaaacccccatgacataattttacctatataacaaacctgcacatatacccctaaacctaaaagttttctaaaaaagaaaaatgttgtattttgcaaaaagtaaacattttcctttattaatactttataattttcagtgtatgtattttcctgtttgattaaatatatttcaaagtatttattcttattattatataaataggatttttaaaatttcctttcagataatctatttttagcctctacaaatgccacttacttttatttagagcaactttactaaattcatgtattaattgtagcatttttggttgtcattgagacttttagacttttctgcctatacacctatatgtcaactgtaaacagagataatattactgtttcttgtctagtttgaatgtctttcatttctttttattgtatcattgttcttgactagaagtggcaagagcaggaaatcttgtacaggattttagaggagaggcttttgggttttccccattgattattatgttatcagtgggcttttcttatatggctattattgtgatgaggtaggttttctctacacctattgtattgagagttttttaaattagaaataggtattaaatttgacaaatatttttccagaacttattgagatgatcatatggtttttgtgtttcattctgtttatgtagtgtatcacattgaatgacttatgcatgttcaaccatccttgcaccccagggataagtcctagttggtcattgtgtacaattttttcaatgtgttgttgcattcagtttgcttgtattttattgagcatttctgagtctacattcatcaaggttactggcctgtagtttacttttcttgtggatgtctttggttatcaggtcgatgctggctacatgaaatgagtttgtaagtgttccatcatctagattttcaaatagtttaagaaatattattaattctttgaatgtttgctggaattctcccacaaagccatgcagtgctggactattctatttcttcttcaatcttggtaggatgtatctttctaggaatttatgtattacttcgcatttatctaatttgttggtgtatatttattcataacagtcccttaagggctctttttatttctgagacatctgttgtaatgtttcctctttcatatacagttttatttatttcagtcttctctctctctttggttactctaggaaaggatgtgtcagttttatttgtctttttcaaaacacaactcagttttgttgacttttgaaatagcttttttgtcctttttaaaatttattttttgccttaattagcattatttccttctttctgataatatttgggttagtatgtatttttttctgtctttggctagttatttttttaggttgtttatttgagatgtttctttttttttttcttcctcagaaacatttaataggtattaacaaacagaagccatgtctctcgaggctgtgagacaagatggtggatccccatgccattaacccccagaacccagggcttatatactataggtaaggagaattgaagtaatttggtcagaatttatggtaagtgtgtgctcttaacagtagtagagtaaaaatcttagaggcattcccagaaccgaggttaatgaaaagccaacatgttggattagcatttaagacagaattggtttagcctgtacactccacctatctgacccagattttacaatttcacattctctcttcttccaagatggtccctgagcctagagagaggttgtttgatattgcacagctttagcagtagtgcattggcaatggaaaacagattgggcccagttgctataatgttccttctcagaaatacttttgctatatctcacaactgttggtatgttttcttttcatttttgtcaggaggtaatttttaattttttaaatttaatcttggacccaatgattgttcaagagtgtattgtttagcttccatgtatttgtgaatcatatggtttcttgtttctttaccattaactgatttacactttcactctattgtgacctgaaaagatacttgatacagtttctatcatcttaaagttgagttgttttgttatctaataggtgatctattgtgaagagtgttccatatgtgcttgaaaagaatgtacaatcttctgttgttgggtaaaaagttctgtagatgtctgttaggttaatttggtctctcctattgttcaagtaagctgttttccattgatttctctgtggatgttctgtccattattaaaagtggaatattaaaatcttctagtattattgtgctgctataaatttctccagttctgtcagtgtttgctttaaatatttagatctgatattgagtgcatatacatttacaatagttatatcttcctattgaattaacctttttatctttatgtaatgaccttctttgcccctggagacagtttttgacataaagtctattttgtctaatgtaagtatagccattctgctttcttttcattaccatttgcataaaatatatatttttccatcctatcatgtttaactatgtgtgtccttaaatagttggtgccaagtttttattctttcagccagttaatatcgtgtgattgggcagtttaatccttttacatttaaagtaactattgatagggaaggatttactattgaaattttactgactgctgtttttcttgttcctttttttctttcttgatgtcttattttgtgtttctttttttgttattgttgtttgacaggctttaattcctttctccttttcttttataactagttttttaactactgtaggtagtagattttcttttttaagtactatggctattttctgtgtgaatgacatgagtcttacataaaatataattataataatctaaaactgataacttctcttccacacaaaaacttcacatttttaccttgttcccattatagattattgatatcagaatttacatatcttaacatgtgtatctattaatgtaattttagttatacctatatttaatacttttttaaattttagattagaattaaaagtgatttacctaccacaaccacaataatatagtattttttatttgcctctataaatttaccattaccgatgagttttatacttttgtatgctcttatattgttatttagcatcctttgatttcaacttaaagtactccctttagcattttttatatgacaagtctagtggcaataaactccctcagctttcgatttttttaattttgtcttaagttttaaaggataattttctgggtatactgttttgattggcagttgtgtatttgtttgtttgtttccgcattttaaatgtatcatccaactcccttctggcctccaaagtttctgctgaaaatccaccaatgatcataggagggttccctaacacataacaagttgtttttcttttgctgctttcagtggtctctgggtgtccagagtatgccagctctcatcattgccctgaaacaggtgagatactgatcctttttagtagtaaccataaatgttggggcactaactggattttccaatttcttctctcctcagggaaaagctgggtgtataatctgctcatgctgaactgagctggggaaaagaactatggcaaatgtttgcaagctcattcaaaccacagactttttcaaactgttgctttgatctctgtagcctccatgggcctaatggatgctgatctccattagttctcatagacacgtcagttgaaagctagttcctcaggtagcagctggaaaagttaaggggatagatatgtagataaattccttccagactgaagctagaggcttgcttttatcattagagtgagcaagtgggagaatttgtggaaatatccacatgcctgtttaaaatggctgctttgttttctatagcccacatgtaaatagtgaatggcaacaccaatagctctcatagacagtgagttagaagccagacctcaggtaggagctagaaaacttagaatgcttgatttgtagtctaacttctttcatagagaatctgggaactgggctttgttgttgtagctagttggtgaatgaggaggtgaagtggaggagatatgggaagaacccatttgtttgggcattttttctcaatgtaccttagtttgtctgtagtagctggccacagtagtgatgattctatttcctgagaggtgagaattgctgccaaagaatgtctgccatggatgagaatacaaagaaaggaaactaagaactctcaaagcagctactagaaacccttcatagaggacaagaattatcttcagttttgagatatatgagaatgattacaactcctttgagcaggcttcacatactgcccaaagatgcttctctagtttgtgtccttcttgctatcagaaagagagaaggaaactaaataaaacaaaataaaaattttagaattttgtgctgtcttggacatggaagcaatgggtcaggatcaagattgtggaaagatgccagttcggatgcaggctagaaaaattagtattgtcctcaactggaatcagcaaccaaaagactaagtgtatgtgtctctgtaggctgaagggttttcagatatcataaaagataagaagtcaagctacacttgtttggaagcatgtggcagagaacacagattaattgtttaaaggatggcccaaacttaaggccaagtcacatcaaacccatcagaaaccaaaagtgtggcagaattcctaacagaaggatgagagaggaagagccttatatagatctgtcttctgtttcacattctgactattctaaagcttttaatgaagaattccctagagtcataaaacaaaggctaaatggtgagtggctgcaaatacacataaaaatatagtgaattttttgaaaagatatactaatttcaggtggctagaaagatttattaacataagtaataaaggtcttttagttgtcaaagtaacttatacttaatatttattgcaattttaaaaaattaaaatgctaaaaattatttgtgaaaatgagttgttttatatgtttacatttaataacaatactttttacataaagaaaatacaataattaaatatatctgaactagtcaaaagataattataagatttaaaattgagtttatgtgcaataaatgtggtaaacaataatgtgatataaaatcttctaaatttaataatattcttggtagaggattctggggcaaaaatatgattttctccatatccctgcccactacccaatatatgataacatgtggcattattaaatatggaaaaatattaaagaatggcagtagactagagagaagagaaggaaaggcatacaggaaatccaggtccctgccctcagagacctctcaattcctggcatatgtttatgttttgaacattatgcaaatttgtctgcatgacaaatttattcttgtttcaggttaagagtagaaatcaacccatagtccttacgattagaattgccttagcataacgattcaatcagtaagaaaatataatagactagagggtaatggagattttaaaatttatattatcttaatatatttattagaaaaaatattagattgctcaataaatcaatggtaactttaaggcttttactgtctactacaaagaatttttatagatatatgaagaatgatggtaaggaagagatatgatgccatgaggcctactgtgagcaagacactgctaatcaggctattaggttggtccaaaagtaattacagtttttgtctttgaaagtaatgtcaaaaactgtgattacttttgcaccaacctaatacttccgcactttggaaaggctttgcctacatcattttggttattgtgagaagacttgcacacataaggaatttttcaaaataatattttaacttgaaatacttttctttgacaaatacagtaaaagtgatagagccaaaaagaggactaggcatagccctgaggggatttccgagcaaaaaaatcccaggggatttgtatgcaaacacttcgctcaataaaaggagaggccaggtgtggtggctcacaactgtaatcccagcactgtgggaggccgaggtggctggattgcttgagcccaggagtttaggacgagcatgggcaacatgacaaaaacttatctctaccaaaaaaaaaaaagaaaaaatagcggacatggtggggtacacctatagtccagccacttagagaggctgatgtgggagaaacgcttcaactcgggagtttgagacccgcctgggcagtttagtgaaacctcatcactacagataataataataataattatctgggtgtggtgacacacgcctatagtttcagctactctggaggctgaggtgggcggatagattgaacccaggatatctaggctgcagtgatctgtgatcatgccactgcactccagcctgggtgacagagaccctctcttaacaaaataaaaaatacaaaaaggagaaagtcatcaaacaaaatgatgtgacttagtctggtaatattcgtcaagaagtcaagatttatgctctcttacaattctgactttcacattgaattaaattaagggtgtcttggcttgtttagtgtagtttagtaaaatacagtcatttgttttccacagctattatattattctccattaaaaaaagaagaagaagaagaaatgagaaaaaaaaatcagtccctagctagaaattttaagagtcaataacatttgggaaatgaaaatatattctgaagtagtataatcatacccaaatttttagactctgtactcaatctataagatgtatgtgagcaaaatattattagaagcaacatgaatgataatcacgcactacaagcgcacgaataatgtttccctgaaaggtacaataaaaaattattcaatgtgaaacaaaacgttgactgcaacaattattaaaatttgactattgaattgtcagtatactcaattatgaagacatttggaaaatataaatgagcactactgtttttgctcattttttaaaaatgaaaatttttggtaatgtctgacctgaaggcagatattcattataatagtcaaatatcataaatacatttcaaatgttatgtattctacataaattactcaggagaggaacatgtaggctcataaacttgcacacaagtaaaggaatgtttcttaggaaaaaattctgtgttaaagatattccacaccaatgtctcaggaaaaggcatttgtagtatactgctccattacctatgcttcataaaaaatgcagctatctaatttaatttagctctgaacagatttcttagcagcataatttatgttttgagaatatctcttaagaatcatagcttgcaatctatggtgcttcaatgaagaataatctgtaaacaaaatctccatctatcaacaaaggccattaaagaccataaaataacccatccttgactgattaatgctgctactgaaagggatttcaggctattaacatccagaaaatatactgccactgtggttgcatttattataaatcacatagttatatgtactggtgtaaagcaatgttttcttaaccacctccctctcccaaattaatttaataacaaagatactttgaagaacactaaatatctatagaaagtaaatgattctatttttttccctagaggaaatgtatgtgaaggcagggctatttataatacattagatagctaaatattggtttaacactttatatgcagttcaattatgttcatatatttatgtcattaaaatagtttctctaatgtaaaataaaacattaaattcatttgtatttcttgatacttttattaacaatactgatggtttttcatgggtaaaatagccatcaaaaattgttagttgttacctttaggttcatcctattctgtcaatttgattgtcactaactcttcctcttaggggatgtgaatatagctgttgagctcatactcttggaaggtaaagaggctttgtttactggtgcagatctcgattttttcaaatatagtatttcacctcagaaatactatctattagctcttatgccttacaaaactactggcttggatttgtccaatggttttaacccttgatcttacctttaacatgcttggaatctcacaaatattttcttatattgtttagtacaaggcactgtctaaatagtttagccacattatctcattccatttacaccaatcccatgagataggtacgttttaaccattttataacataagcaaaactcaatttcaagaggttaactaatatttccaagatcacatagctagtttatggcagaggaggattcaaacacaggactgtgttgattcaaaaatctatagagttaaatgtgtacttgtccttccgtaatatctgaggctagacaaaacaatccctggcttttctctcctgctttctatgaatattctgtcttagactacttagtcattatatatttttgtcttttcagtagagttctgttttgctgtgctagttcttttgggtttctataataataaaaataataataaaaggagaatagaagaataagagtagatcagggagaagatattctgaagataagttggtttaaagagaatgagttaatggatcagcttttgtctctgaagtcaacaaatgacaaagaaatgaaaaaggtgtaccctggaacaatgcatctatctgctggtagtacttgagaaatacatacaaaattcatatttttattttcttttgtttcattttattgcttattttggtcagtgttatttgcttcttatactagtaacattcctccagcacagaacaacatatctttgcaaatatttcattaaatatataaatgtcttaaataccacaaatgaaagacatgagtaacacaatatagtccacaaaactcaaaaggaaataaacacagtttagcatttttttcttacaattgaaaagattttaataactgttgagtatttataattatctatgctaactcccattttcttgccaagttatgtgtctttaaacactatggagtccccttgcaaaatttaacagagaagcaaagatatgtatcagtaatattgatgtttttatttttttaaaaaaaacctccctgataatttaagtgaattggattagaataattaaaacagaaatgaaggacacagaagcacatattctcaatatcgtcacctctgattactttagaattctgttagcatgtgctgtaaaaatcctttttaaaataaatattcccactataagcttaagtttattcatatctagggagaattgttttgttcggataattagatcaacagctgactctttaagctgagataatggcccactagccaataggaatcacacatgttaaggagaacagaattcaaagagtctggtcccttttgcacagtgacagaacatatgaggcagctacatatctagagagacaagaagataaatataagagagcaaccaaatcaagatgtaattactctgcatttaatcaaggcaccttagggttagtccagaccttttatccaaaacagctctgtaaacagcctactaaaccagcatcatcagctttctgtatttctcatctgtctaagtcagtcttccttgtttcaccatattcctacttgttttgtcttcaacactttctgagagaatgaagaaaaatgacaaaaaacaaattgtatgattgtatgaatgattaatatctcctctttcatgttgttcctcttctattgttcaaagagtatagagtgaataaatacaaaaacaaacacaacactgaagttaataaataataaggtccatctcatttgttaaatttcgtttcttaaggtatatgtgtctttgaaccttctggttatttctacaaaatagttctagtggctttggcagagtggtagcataacacatcactttttaaacagagttgaataattgtataaccctaaaagtaaaagaggcaaacaataaaatgaaatgaacaaatgaaataaaatcagaaattctcagcttaacaaaaccacctttcttgtgagcacattttgtgcatagtgaaataagggacatatctctaaagctctgtacacatatatttattaaaataaattgaattaacaattggcactacacagagtggcatgaaaaggttcagtatcttaacctcagctattcactaagataaaaggatcaccaacataaaatcttttttctttgcattgttaaacttaaataagtgttttttctctaaataaaatgattaatttttaattatgtagataaattttggatctaggtggactggaggcataaatgacacttacttagagatataaccagcaaagtcaagatggcaactttacagaaaaacataatctaaaagtttgaaaaacaaactgcagaatatattgtgtgtggctctttttatattctaaactatgttataaaaattttgcctcgacttacttatataagaaaaataaaactggttgcagaaatataatttagtattatgtcttgtgtgacctaacaattgggtaacaattatactaaaatgggacataatttattaatttacacagtataaaacctattggaatagactttgtaagttccaagtaagtttcttatcgtacctggtcagatttactttgcaatgtccatcttaatatttatgtttttaatatttttaaaataaattttaaggcaatagcatgaatagatgaatacataagataataaatgaaactctagctctttataacttaaaagagggtaggataaagaggcatggcataattttacattttaacttcagtagatgacaatatttgggaaaactaaggaaatatggaaggttagacaaaaataccgattcagggctagaaacaatatttatattttacaatgcccattttagggaaacacggcattgctatgtttttaaagcacgctttagagagtgaaagagttcactttagaaagtacaatttagaaggacttcactttctaaagtatgccttagaaacacagcaatgctatgtttttctaaaatgaagagaaagaaactttatcactctcaaacagcaaggcttaaaatttgtagagaatgtgaatgaggaaaagaaagacaattgttcaggaagttcaataaatcatatttgctgagtcattgagttattaaattcagcaaatatgattcactttgtggcataagtaacagggaaacatgttccatcacaatttcaagatgaaatataaaaagcttcagtctctcttttgtctctctctcacacacacatacacacacacacacacacactcacacacatacacatatgcacaaggtaattgaggctagggaggtgaaagaaatgtagagtagggtctctgacaaatgtggtgaagggtctctgtgtacataatgattttttgaacaatctgaagacaattaagcaaattcagaataattttaacatttcagcagattaactggtattaaaaggggaaaagattggcagaagctttattctaatcatgcaccagaacaacaacaacaacaaaaacacacacaaaaaatcaaagtggcaaatggtttcattgattattgtgaactatccggcacccacgagaaaacaataatccaaatttgttagctcctcaaccttggatgagttttcatgagtattttataaattagtgctataatggcaggagacaacgaactcccagaccacttccaaatttaaaattatatagttttccattgaatagtttattattttcttaataaagataactgtttcttaataaaactaatgctatataaagacaaagtggataaaaaatcattagcaagagaattagtaaacaatgcatagcaacatacatgcatatgagcatatatatacacccatatatgcatatacactagacctatatgcacataattgtaattatatattagtataacaataaaaatcctaaaatatctcaaatgtggaaataaaaatgctgagccaacactagcctagagggctgagaggccagaagagattttgagtttcaccatctgttggatcattcaagcatttcacaacttcctgccagtatcaaatctccgctattttatttgttccaagaaattttaaaacaaatgagagaggtaaaagcagttgaaaatgctgaaagttttgttcactttaaggggttattgttgaggcaatattgctcattaaaggaattttaatggcttaaaaattaaagcttttcaaagtcaagtactttatccctttggaagttttagcaatttaaacttgaataattttcatgaccaaagtaactgcaaaactataattttatattacaattgtatttgtaccatctgacctaattattaaatgtttaaacataataaacactaatgaagtgctctgtcactacaaataagcttctggtcagggtgctattgtcattctactttcttcttgtagttttgttacttttctcgtgcttgtccacagaaattcccaccaagagtcaaagttccacttgcatactcctgtgtgtggaacaagggtttgggatcaaagagtctgccttttcattctgggctctgctacttattacctcttccttgaatctatatttttaatctagagtttctaatagttgtgatgaggatcagatgagatataaggcagaattgcatttgtcaaatggctaatatatgatatgtataagatatgctaagtactcagtaaatggtaattgtttttgctatttctgatttgggcttggattttaatttattttttattgaatgttggataggtatttacccattcacacaatgttgtctaaatgttcatcatactttctaaagttaagggataaagtacgctgaaaggtagctattacctaaaataataactatacctcaggcgagataatacatattatgaattgagaataaacacgcattaaataagtggtaaagcgatacaaattgagtttatacagtagaaaatagaagggggttatttctattggcagccataaggctagagtatgttgggcataattcttctttaccagatacaatgttttgtatagaagtatactcagtagattttttaattctgtgtttctggaactaaacagaaatgtgtggaaattgtagaattgggcaagaaatggaattagaagattcaagagttaatccaacggatgtgcatagattgaagaaataagtccaagaaaataataaatggattagaattttgcaatctctagtactcatagttttttaaaagcaatattaatcaatgaaatacatatatgtgcatccattctatgccaagaacatcacagttaccttggtacttgagacacggagacaaataagacactgtctatctctataaaaacatcatagactttcattctagtgagagagaaaaacacacataaactaggaatgacaaaataagacacatacaaataacaacgtgtgaagcatttcatatttacaaaataaacataaaatactgttcattttctgaaaaactttctccatttatcttgaaatatgtagtatttctgtcaaattttataatctattattaggtatagaaacataaatacagagataagtttttcaataataaaaatattcccagtggaaaatggcgatggatacttagtcttaatgtcagtggcatcacagggattggtacagacactggtgaactaaaaatatcacacggtttaaaggcagtggactatacttggaaattgttgctgtagacaacagcaggctcagcattaccaaattatctcatttttttgagtagaaataaattttgatattttaatgtgcaaagcctttaaaaatgtgttcaattcaaaaaagtggctaagaaaaaaattaaaaataaagtttaaaaaaccctcaaaactatatctgtgggtggaatcaacattcaggtttctgctgtttgatcctgaactcaaggacttataaaagggaggcatgaagaagagctctgcaaaaactatagaaaattggaagatacagaaagaacactgaagaaaaagctactgtccttagattttctatggaaaattaggtcaggtataaagaacatattcctaatcagatgaggaacttttaaatcagtgaaatcatagaactgcttctttggaggccttaatttttcatctgtttggggttatttaaatgaagccattgcaagtgtgtcctattttttcaaagtatattttgtggactccccaactgtaatcacaggatgtgcttgttaaaatgcagattcccagacacctttccagatacagaatcaaatatttttggttgggtacagaattctgatttttttaaaaaattaactctagttaactttgatacaaagtacatgttgagaattataccactggactcacagccaccaaagacacttgtttagttggcgactttgagacccagtcagacttatgagtacctcggaactggaacccaagagacgtatttataacaagtttaactaggtgacattaatgtgtcttcagctacatggaggctatattttattgcattatatattcttccttcttgttactaatttctttggatgcccgcttttacaataaaattaataatttagaagcttataacttctttgtaaaatggcatttctagcccaaatacttgtttaaattcagcataaaaaagaaaacctagttcataagtgatatgtcattaaggatcactgttgtttatcatgaatttcattgtatctttaaaaacatgacgtttttatttttattttttaatttttatttatttatttttttaagtagagactggatttcaccatgttggccagcctgtctcgaactcctgacctcagatgatccaccagccttggcctcccaaatgctgggattacaggcatgagccactgcacctggcctaaaaatatgactatttggtaaacatcaccagggtcctaagaatattgtgtagattatttccagtgggatggtagccattgagcaaccaactgatcaaattttaagatcttgtaagatcttgtaagatgtaaaatgtagcactttcgtaattacctaacttatttgtgaatctgcttttgaataatagtaaaattgtgttttcaaagccatcttactcagaagtaaattatgttaatatacaataaagagaacatacacttttactatatgtatatggaaaattactatatcataaggtcttctatacagctaaaatttttgtgacctgggtacctggacttcaattgagtgagaaaatgaaactaagaaagttacagcattgatgaatagcatagtatatactatattaacagtcattactatatattaaaaagtagcttaaaagaaaagaaaaggccaggcacggtggctcatgcctgtaattcgaggtgggaggatcacaaggtcaggagttcaagaccaacctggccaagatggtgaaaccccaactctaaaaatacaaaaaaaaaaaaaaaaaaaaattagtcaggcatagtggcgggcacctataatctcagctacttgggaggctgaggcagagaatttcttgaacccgggaggcagagatcgcactgagctgagatcgccactgcagtccatcctgggagacagagtgagactccatttcaaaaaaaaaaaaaaagaagaagagtaagagtaagaataggagaaagaggaggatatagaatggaataagagtcacagaatgagagtattcagcccaactgtaactttgttttcaagatatattagaagcctggggaattcttctataaattctacttcccatttagcatgttctaaagttcttctgtcatgtcagtataatatgagaagaggtaatgtattttgatacctcctgttttctatagacaaagtatgtagattaagtacatgagtatttgaggttcaaatgcacctattaaaatgacagtataagtatctatttaactggagcaataaacatacatatctttcctaaagtgatacttaggttattacaaatgccctattaggtttagttatcttcctcatttaaaacactttccacatacagatagtagtagactactaaccttatgctggaacatacattatgatgtaaaaccggggaaatatttcaggtaaactcattctcagcagtggtacatgattatgaagctgtgttttatcaacatgattgctgtgagcaccaaataagaacatgcaagtagcttggttagcataatgtatagcacagagtaagaatataacaaatgtgagttactaggattgtaaagattatcattattattgtttgaatagtaatctctgtatgtaaatagacatacatattctactaacagatttgtgttatctacttgagtgtgtgtatatatgcgtgtgtggctatgtgggcaccagtggagcaataatgagtttgctacatgttatatatttctagaatcactaattatgttgaaatattattacaaaagtatgtgccttaacaaactaataaatactttggtgtctaaataagctcaccatagagcaaaatatatgaagacacacagagatagctatatatagagacaacggcagcatgttattccatatggaaaaaaaaatttgtatctgcagataaaatggcactccaggaggatatcaaagcatcaaatggatgttttcattaaaagaaaatttgtacatgaatttttaaaatttcagttcatgatgttactcattagctctatttttaacaaaatgttcccttttgcatagagaaaggaaagtcaaacactgatcttcaatattaatagttaagaacctgaaaacatcttacattttattttataggtttaatctaacttaaaaaaaatgttaaataaaagacaatgaaattgaagacccctcctggagaaactagtgaggatactaatatagactctacctcctcaaaaacctaacttcaaagagattttaaagaagtcatcaattctctcacatggcagactgggataacatctgttaatagagacttaaaaaaagtaagtaatttaaggaagaagggttgataattcattgattgggataagagaggaaatggcaagagaaacaggtatggtttcataatgacattgagataagtctcaaaggctgaaggaagaatttaatataattattacatctagtgatactgatgagaaacacatcctttctccctcagttttctttttgtgcgtaatcttgtaacagattgttcatgttttcagtaaatactgggagtgaggaatggtggaatgcagagatgttaagcagagggatttggtcccaccaaaggtactctaaattaaataagatgtgctcactttgcaaaagtgacttcaagataagtgcctagcttccaccattactgctatactccacttctaacaaaattatcatctttaattttctagactgccgcactagaaccatcatagtgtggaccaaatttacactatttttctacttcctatttctattcttctaaagttcttaatctgtgttctaaatctgggactgggcttctaagagtaggttcactgattgtgttatccaagacaggggttggcaaattatagctcaccggacaaatccaacccacacctgatttttgtaaggctgaaagggtaagaatggttttgacatttttaaacagttggggaaaaaatcaaaaaaacagatatttcttaacatgggaaaattatataaaatttaaatgtccacaatcttgttccccttttaaagatatattgttgattattttaacactacaacaaccagagttaaatcgttgcagcagagatgacgcggcccacaaaagccctaaagatttactttgttctttacagaaaaagtttgctgacccccaactcaataacttattttatataaacataaatttttcaggaaaataatactgtgaacccataatatgattgtagcataatgggaaaattaggcaaagattgataaaataccaatcttattattatacagtcacatatcatataggaaaaatctgatacaatggatttaatatatcagatgggaatttgagataaaaaagattctaatatttctagtcttataaatgaaactgagcctaaatgaagctttcaggggaaatgatcatgtaagacaaattacaggggttggtttctaaaaccgattctttttactctttactgaaggtcaaggatactgaatgtgccagtgcaccttcagaaagcagcctgcatcagcacatttaaaccactgaatggtctcaccacctagtttcttgcgaaagctgagcaatacattttgtgatagataccactgagaaagttaggcagaaattgttattagtagtatatgacaatcataatagtctaacttttactgtaaaactctattatttatatgttttctgtacatcctgtaggattgtctgtattttgcaatagaattgcaatgtgtaagagaaaaagaggcagtctatgtttccattgtcattctaagggacatattatccatacaacacctcctttttcccctttactgaaaagctgtgtataaaacactctaccatgctttcctgaaacataaaagaagatttattactattttaataaagaagtaagaacaaaaatatccaatctcctaatattcaatggagaagaatatatattcttttttaggaggacacaaaaatagcaagcttaagtatattctgttccctaaggtactgtgtaggtggagaaaattatttttcatttaaaattatatacttgtagttcattttaagtaagcccagtggacataaagctgattcattcacaaatgcaaaattttgttgtaattatttgcttaaccaaagcaatattcatcaaaaatggattaatgctaggattattttatttcaagtaaatgaacatatattgattagtgaccttccaaaccccatgctagcaacagtaattactattattaataaaatacatcctctagtgcatattaaatggttcaatttattaaatatgctgatctctgcatacctcctcaagattattttttaagaaaagtttactttgcctgagaaagaaaagatgaaatatgcaaacactaagtttactaaaaccaccaaatacaagctgccttggagtcccgttgttctgaattgtcttaccctcttaaaatcagatgttttaagcagataactcaatttttcatacaatataaaatgtccaaaatccgtgtaattctctgcctctgaatacatagtctctatctatttttctcattgttttaatctaaaaggaacattatgttttctctttttaaaagtaccctccttcagcattgtttttacttctaaactccttagattttctcctcaaatcccatttttctccgcacaatctcatcctcctttagctagaatcactcactggtgattaaacagagtcacgcagaaaataatgaatgcaaaaatgtgggcaggaagaaagataagggaagaaatattcttcaggaaagaaaatgaaacggtatttgtcagcgatgttgtaaaggggaagaaacattagagaaagggtgattggttgatagtgtcaaacgctgtaaagaaaggaaagaagaggtattttttaaattagcaaagtggagaatcatttttaaactttgagttagagttattactgaggaatgagaatttaagtttcctttgtggttttctgtgcttactaaatcaccagctcttcttataaggtgagtgatatatagtaagaatgagagtctgtggggaaggctggtgaacatactttgatgaaaaaatggactgtaaaggagtaccatccctgtcataggaagagatattttagtgtctgaatctgtgagggggtgtgtggaggtcaatgttgatgctctatgtatctaccggaggaaatttatgtgtgtgtgtgtgtttatctattgtaaggggaagccgtgagatatcagacttccctggcttttcctatctctgataagaaacactgtagttctagggaagctgagcgctggaaaggaccttgactttgataaatacaataattggtgacaagatttaaattttgttttccatgagttctggtgatagggcattctggcttgttttatgtcatttgtcctaatcctcttaacctcttaacctattctacaaaccactttaaatatttcttctcattattccaaacccttgctgtcaaacatcattgtaacctgtgtgtatatatatatataatatatataatatataatatatataattatatataatatatataatatatattatataattatatatatactatataatatatattatatataatatatattatataatatatattttctatatattatatataatatatattatataattatatatatattatatataattatattatatatatatttttcccactacagtgggaaaaaccattaatccagtggctatttcctgtacactatctctcgtgtctgtgagctcctttctgtttctattgccatcagtgtctttcacaacctcctctttctttatgatgtgtttcaaagcagattctttattttcattctcccaagacctgctgcaccttgcctactaatgtcagatacgttttcttcaaatgtcacacttcaggttagttatttgattgaatgcctatgtgattcccactacttccatataaagtccaatccaatcaacttaattattcacagttttgttcaattgattttactttccctgcctgactttccatttgtctattcaaggtagactagtttccaccattgcgctgacttcttgccctgaaatcactacttacagccttactcatcaaagcaaacgacatcaattaatgaagtaaaactcttgtcctaggctgtctattggtcttctctgatcctttggcggcagaagctctgcatacatccatcttgcctagacagtgttatgcaaattaacacaaccaaaaacaaaagtcaaattgtggttccttttatatattttataagtactattattaataatgaaaagacttttttttaaaatttgactaacttttttacataatactatctacttcataacatgaaaggattaagtggatttttataaataatgtgcatagaaccatgctgagaaaaatatgaatgttctaacattggtactgattgttattgttatttttactgctaattcttaattagtagagacaaatgttgactgaactatttctttggcgagaaataaataatgccatattttgggctcttcaagccgagtctcttctggcttggaacactaaactatataaattgacccttattatttaaaatgtaaaccacattaaaaattcattttcttaatcaagatgaagctaagatatttggtttccaaaccattaaaatttttatgagcaattctctgtaaaagcatttacctctggtatagtcgactactagttatgtactaataactattactaggatccattagctactcgctttgatctgtgttgtcatgaacaggaagatttggaaactgttgatggtttatacattgactatacaaaatactatattttaaaatgaaatcatatgaaattaatttatcaagattaactgtagtgattacaaggaaagaacagagagtacatgtttgatacattaaaaaatcttttcaaaaaccaaagaaaatcatgggtttagattataaagtcataaggtgataaggcaacttttgctcatgcggaaatatgttaattagttttataatattgtttctccatcgaagtacttatacacgtgtttggctacttaaaatagggtaaagaaataaataaataaattataatgctctaaatgaaatttggcatataccatctctcaaatttgcagtttatagtgcaggaacaaaaaagaaaagggaagtgtgatgaaaatatttagaaccacttgtctagagtttaaaagaattagtagcaaaaatattacaaaatataaaactactgattgccttgaatttgttacctgatcccaagttatgaacattaaaagtgtcataaagaaacaaagtcagacacttgttaaaaatagcaagacagatcttagtaagatactgcagtagggaagagagacttcagtggaaactgggttcagctctgatgaaacaaaaggcagaaggctgtttaaatgctggaatatgctaaagtaggggttcccaatccctgggccatggaccagtatgggtctgtggcccgttaggaactgggctgcatagcaggaggcgaatggtgagtgagcaagtctaagtaacactttgtatttacagtggctccccatcactggcattattgcctgagctctacctcctgtcagataagccacagtattagattctcatagtagtgcaaaccttattgtgaactgtgcatatgaggggtctaggttgcgtgctcctaatgagaatctaatgcctggtgatctgtcaatgttcccatcacccaggtgggattgtctagttgcaggaaaacaagctcaggactcccattgattctacattatggtgagttatataattatttcattacatattacaatgtgataataaagtacacaatacacgtaatgcacttgaattgtcctaaaatcatccccccaccccactgggtccgtagaaaaattgtcttcagtgaaactggtccctggtgccaaaaagactggggaccactgtgctaaagcaaaagtaccaaagcactttgaggtggatgcttaatgtgattagcccagttgtgtttgctaactggcacttacagaaataaagtccctactttaccacagagactgggaaatagaggccctatctttctcaatggttacatttcaaaaggaggtctcccaggtccttgagaaagacattcctgagttgcagatacatttcacaacgacaaggaaaggactacaagtttcctaatgtaaattctctaagaaaagggaagtctgggacccatagccaatgatatggtttggttctgtgtccccacccaaatctcatcttgtagcttccataattcccatgtgttgtgggagggacccagtgggagatgactgagttatgagggggagacttttcctgctgttctcatgatggtgaatgggtctcctgagatctgatggttttaaaaatgggagtttgcctgcacaagctctctctttgcctgctgccatccatgtaagatgtcacttgctcctccttgccttccaccatgattgtgaggcttccccagccacatggaactgcgagttctctattaaacttttttcctttgtaaattgctcagtctcaggtatgtctttatcagcagcttgaaaacagactaatacagtaaattggtaccagtagagtgaagctttgctgaaaagatacctgaaaatgtggaaacaactttggaactggctaacaggcagaggttggaacagtttagagggctcagaagaagagaggaaaatgtaggaaattttggaactccctagagacttgttgaatagctttgacaaaaatgctgatagtgatatgaacaataacatccaggctgaggtggtctcagttggagatgaggaacttgttggaaactggagcaaaggtgacttctgttatgttttagcaaagagactggcagcattttgcccctgccttagagatttgtggaactttgaacttgagagagatgatttagggatatgtggcaaaataaatttctaagcagcaaagcatttaagaggtgatttgggtgctgttaaaggcattcagctttacaaaggaggcagaacatgaatattcagaaattttgcagcctaatgatgtgatagaaaagaaaatcccattttctgagaagaaattcaagcgggcggcagaaatttgcagtagtaacaaggaacacaataggggaaatgtctccagggcctgtcagaggtcttcacagcaggcccttataccacaggcctggaagactaggagaaaatggtttcatgggcagggctcaaagtccccctgctgtgtgcagccagggacctgatgccctgcttccaagccactccagccatgggtgaaaggggccaatttagagcttgagctgtggcttcagagggtgcaggccctgagccttggcagtttccacgtggtgttgagcctgcaagtgtacagaagtcaagaattgagttttgggaacctctgcctagatttcagaaaatatatggaaatgcctggatgtccaggcagaagtttgctgcaggggcctggccctcatggagaacctctcctagggcagtgcagaagggaaatgtggggttgaagtccctacacagagtccctattggggcactgcctagtagagctgtgagaaaagggccactgtcctccagaccccagaatggtagatccactgacagcttgcacagttcacctggaaaagctgcagacactcaataccagcccatgaaagcagctgggaatgagactgtagcctgcaaagccacagggatggagcttcccaagaccatgggaactcacctcttccatcagtgtgacctggatgtgagacatggatttaaaggagatgattttggagctttaaggtttgactgccccctggatttccaacttacatggggcctgtagcccctttgcttcggcaaatttctcccatttggaatggctgtattttcccaacgactgtatctgcattgtatctaggaagtaagtaacttgcttttgattttacaggctcataggcagaaggcccttgccttgtctaggataagactctggactgtggacttttgagttaatgctgaaatgagactctgggggactctcgggaaggcatatttggttttgaaatgtggaaatatgagatttgggaagtggaatggtatgatttggctgtgtccccacccaaatctcatcttgaagctcccatagttcccacgtgttttgggagggagctggtgggagatgattgaatcatgggggcagatctttcccgtactgttctcatgatagtgaatgggtctcacgagatctgatggttttaaaaatggaagtttgcctgcacaaactctctctttgcctgctgccatccacataagatgtgacgtgctcctccttgccttccaccacaattatgagacttcctcagccatgtggaactgtgagttttccattaaacttctttcgtttgttaattgtccagtcttgggtatgtctttatcagcagtgtgaaaatggactaatacagccaggttttggcagaaacaaacattaacttattttagcaatgttgatgtttgtcaggtagacatttaagtgggctgggattgttaacctgggacacagccttgaactgttaaaaagctgtgctagaatttgttcaagtctcttagtgtgggacatgcacaaaatcatttatgctgagaatctgcagttctcacaggccaaggttaagtcccagtcaataaaaatgctcggaggagcctgactaaagtctggtcaaggagagagtctttgccataagaaacttaataataactaatatctctaggctactatttgtcatgcaatgagctagtatttgcagctttttcttatttaattctcatatttcctcttgaggaatatactaggattactgcctttatttgaaatgtgtaacaggctaagtaattttttcatgaattaatgctgtcctcatttatttaaactgtattttcataagttagcactagatacaggaaccaagggaacaggtgtagaagtcccaagaaactgaatgtgtgggcaaagcaaagaatggctaaacacacaacatccactgagttaccatgcacgagaagaagcaggaagatgtaggtcccctgttggccttatattcttcccacataaattatagattaacatatttcctgattttttgaagtttccagagatttaccaacttgatctttcatgtgactttctcttattctggattttcagtgacttttcctctcactttattgtctctaaaatcacagaaaccctgtttaccacaattattttcttaaatttatttctacaggtctttagttaaaaggtacagggaagcagacaaaccttaaacttgataatacgtgggaaataatgttactggtatcttagaagtcatgccagtaattcgtctaaatttaagcatcaattgaaatacggatgcaaaattattatacgtgattaattactttaggtctttcatcagtttatggtagagtaaccaaattgcccttgatgcctctcatgtgtcaagtattgttttgggtgcaaaggatagatcaataatatgacatggttcttgagtcagtttggttatgactggagttggtgagaatgttagactcacattcatgagtggatttgataaatacaatgtggctgacatgatgtctgctctcaccaagacttccatttcagttctttgatttctcctttgctttcgttaggaatggcctatatttggtacaccaaaaatttacactaattagtgagcacttctcctactttaaaagagaagctcaaacaggaaagaatacacacacacacacaatttttttggtatgagattcaaaattcctagaaagcttatgacaaaattatcaaatttgttgaattctcaaaattgctaaatttctgaataatgttcatctagctacagtacttattattccaccggaagaaagcatatgcttcaacacaaaaaaaaaatttgagtgcaaaactattaagtaaaactctgagaaaacatcatttttgtacttggcaataaggcaattacttaaaaaaagttagctaatatttgtgagtgttacatttaattaaacattaaagaactttatagaagtatttttaaaaaggaagaaaggaagaaatgtaataacccagaattcaagagaagataagcaaaatgttatttgacagaatccagaagcacatgaaaaagttaattcaccatgatcaagaaggctatattcctgggaagcaaagttggttcaacatacgcaaatcaataaatttgattcacctcatacacaaaacaaaactgaataaccatatcattatttcaacagactcagataaatcttttcataaaattcgacatctctttatgataaaaacctacaacaaactaggcattaaacatacctcaaaatgataggaaccatgtgtgacaaacctagagcaaaatcatactgaatggacaaaatctggaagcataccccttgggaactggagcaagacaataatgcccactttcaccattcctattcaacatagtactggaagtcctagacagagcaatcaggcaaaagaaaaaaatacaaggcatctaaataggaaaaaaggcagtcaaattaactctctttggtgctgatataattctgtacctagaaaactgtaaagactctttgaaaaggcccctagaattgattagcaactgcagtaaagtttcaggatccaaaatccacatacaaaaatcagtagcatttctatacaccaataatgttcaagttgggagccaaattaagatcaaaaacccatttacaatagccacaaaaaaaattaagtaggaatgcatccaacaaaggagatgaaagatttctagaaggagaattacaaaatactgctgaatgaaatcatagatgaaacaaatgggaaaatgttccatgctcatgaactggatctaccgactacgtttttcccagaactagaagaaagtcttctaaaattcatatggaactagaaaagagcttgaatagctaaagcaatactaagtgaagagaagaaagctggaggcatcacattacctgttttcaaattgtatataaggctactttaactaaaacagcatggtattgtcacaaaaacaaacacatagaacaatgaaacagaatagaaaacagaaataaggctgcttacttacaaccatttgatcttcaacagactcgacaaaaattagcaatggagaaaggactttctattcaataaatggtgctagtttaactggctagccatatgcagaagaatgaaactgcacccttgcctttcatcgcaggcaaaaattgtcttaagatgaatataagacctaaaactataaaagtgctagaagaaaacctaggacatggcattctggacatcagccttggctaagaatttatgagtaagtcctcaaaagtaattgcaaaaacaaaaattacaaaaaataaaaattgacagttgggaccctaaagagcttctgtacctcaaaataaactatcaacagagtaaacagataacctatggaatggaaggaaatattcataaattatgcaacttacagaagtctaatatccggagcctctaaggaacttaaacaattcaaaagtgaaaaaacaaataagctcattgaaaagtgagcagaggacatgaagagacagttctcaaaggaagacttacaagcagccaacaaacaaatgacaaaccctctacatcactaagtatcagagaaatacaaatcaaagcaaatatgagatactgtctcacaccaatcggaatgctattattaaaaagtcaaaaaataacagatgttgatgatatactttgaatatatgtccctacaatatctcatgtaaaattgtaatccccgatgttggaggtgggacctgcttggaggtgtgtttgggttatggaggctgattcctcatggcttggtgctgtcctcatgacagtgagtgagttctcatgagatctgatcatttatcatttaaaatgtgtggcacttccccacctctctcttgcttccactctgccacgtgagagccttgctccagctttacctttcacctgaggcctccctagaagctgagtagatgctggtgctgtgcttcctgtacagcctgcagaacaattagccaattcaatctcttttttaaaaaaattacccaatgtcaggtatttatttatagtaatacaagaacagcctaacacagttgctgaggctgtggagaaaagggaatggttatacactctaggtttgaatgtaaattagttcagcctctgtggaaagcagtttggagatttcccaaagaactcagaactaccgttagacccagcatttacgtgactagggatacacactaaggaaaataaatcatcctacaaaaaagggacacattactttgtgtgttccatcatagcactatgcacaaaagccaagtgtattagtctgttttcacactgctataaagtactgcctgagactgggtaatttataaatgaaaaaggtttaattaactcacaattcagcatagctggggaggcttcaggaaacttacaattatggtagaagacaaatgggaagcgaggcacctttttcataaggaggcaggaaggagaatgaactcaggaggaaccaccatacacttataaaaccatcaggtctcatgagaactcacacacttcgcgagaacagcataggggaaaccgcccccgtgattcaactaccttcacctggtctctcccttgacacgtggggattaaaaggattacaattcaaaatgagattttggatggggacacagccaaaccttatcatcaagacatggaatcaacctaagtgtccatagattggataaagaaaatgtagtacatatacaccatggaatactacacagccataaaacaagaatgaaatcatgtcccttacagcaacatggatgcagctggagaccattatcctaagaaaattaacacaggaagagaaaaaccaaatactacatgttctcacttataagtgggagttaattattgggtacacatggacataaatatgggaacactagcactgggaactactacagagggaagagtaggagtgggtcaaggtctgaaaaaatacctgctaggtactatgctcactatctaagtgatgggatcaatcataccccaaaactcagtgtcacacaatataccatgcacatgtgccccctgaatctaaaataacagttgaaagcataaaacataaaataaaataaatcttcgattggcatgataaatgttaaaaattaaacatcaagggaaactgtgtgagaaacatatggggatactctgtattaccttggcaacatttcagcaaatttaaatttatttcaaaataaaaattcatattaaaattacccctgctaaaattttaattaacaatatttataactttaaaaaggaaattaaatgtgtttcaagaataaggggacactgacatcctccttcttccattctgaagaagatcataaaacataagcacctgcacctgccccaagactggatcaaaaggtgaacacacagatctattaatcactcatctaaaattctcaaacgctaagatattccatagactctaaagtcagacctgaatactacctcaaaggacttgaacaagaagttccaagaaaaaaatagcaacagtagttttaggaggaaatgtgcataattaataggtcaacaaggataggtaagagacagatagcctgaattcccactaatgggaatattaaaaagaaacaatgaaagaaaagtatatacttacctgtacaaatgaaattgtaaactaaagagaattccagtttagcagattaaagctgaagtcttgactcaaatttccatttggtctaaaaccataatggaatacggagactgaaaaaaagcccaagtaaatgagacacatttctgtggaaggagttaaatgattttatttttttcaacagagtaacctgaagaagggagcctgcataatcctgaaggtcagggagcaaattaaagagtaaaggggcatccactggagattttcttctgaatgccttgggttttaagcatatccttttgtgagatgcaagggatgttgggttgtaggcagagctagaaatctttcccttcttattttctagttcttttcagaagttgccctaatcatttagaaaggagatttgcatgaacctgaaagttgcagagtttgctttgtaaagaataagaaacactagtgtcaaagatcaaataaagaaggctggttgctttacccgttattcaggcagagaaggaaaatagtgaactgtgtggaccatgtctaggttcaaggaggagacaggtgaaagcccagagtacctaacagtggagaatttctggacactggaggaaaaaaggtttgatgtgaagaagattcaaaaagtaaaatgaaaaagaaacagtgtaaatatgtcctccccacacaaacactggctcactgagggaaatgggagtcttcgtaatctccaaggtttcagaaaatataaagtatctacctgtaaatcaattacgccccaacccaatgctaatgaatgtactttctatggagagatctctctgcaataaccatggagaactgaaaaactaaacctaaatcataagaagagtttaggcacatattaggagtgttttagagaaaatgtcttctgacagcatggttgtacacaaatcagccagaacttttcatgaccccatgcattagctgatatgccaagatgcccatgcaccagccatgaatctccttctggccactggagccaatccttatcttcataaataccttccattactttcaggtttcttgtgtccatagccaaatgactgaattaaactctgaaaaacttgtattaggagcaaccttgattcttaccaaaaacaatactgcatttcaagaagatgaaactttttatatggtaaattataaaatcttgcactgctttctatacttgtatcaggagcacccttgattcttaccaaaaacaatactgcatttcaagaggatgaaactttttataaggtaaattataaaatattgcactgctttctatacttataaatattttgcatatgtcattatagcaaataacaatttttagaaataattaaagtctcaaagtgttcctttcttgaagtcagcagcagttacaatttgttgtaactagaaaaactgaataatattttattcattttaattattggaggtcatataagtctctggacttactgtattttatctaaaacatgtattttcattttggaaatggagaattatttctttattaatctaagcatgtctatgcttttagaatatgaggcaggctctgcaattttcttacaagacgctaaaggaatggaaagcaaaatcaacaaaaggaaaagagactgagaaaaaaattatacatattgtttataagtttggtgataacaagagttacttttaaagatgcttgcgcgtatacactatcttccaactgtttcagatgtaaatatattaaaacaagcattttaacctcagataaataaaaaagacacatagttaggcatcttcacaattataaactgctgcttattcttatccatgctcctaaaatgccttataatatctgctgtcactgccttggattataagcccaaaacagaattttctttttttaatagataatattataaaggtgattttctaagtgtacacggcctctttaggaagatagcagtaaggctcagatgtatgatttatagagcagagcttttaagccataaactcatcattgatgtcttacagccagatttaattaccttcctgaattttgattattttttccttgctttaaacagatcacacataaaagtatgcctacgtgatatatagtttttcttgtttttgaaatgtatacaaatagtctcctataaataaataaataaataaataaataaataatttattcattcctggacttgctttcttgactcagtcaagtcaaagctaaaatgaaagcaattattttagagacctatgtaaaatacatgcttatttagctgagatttgcttcaaaaactcgagtaaaacaaagagctccatgtaaaaatggtgacattcgtgtttaattttccttaattcatctcatatatgtatatatatatatgcacacacataatttcatacactgtgtaattttacaatctgtactgtcaccaaaatttacctattttatcttgtattctaccagagttctattacatggaaattgtgaagttcacagtaatataactactctaagttgttaatcacatataatacattaagcattgtgttgggtaattggcattcttttatctcttttaatttaatgaaaattgtattagttaggataggcaataatgtgttatggtaacaaatataaaacatcagaagcctaaaataagaaaaattatatattgttattcactctcaatgtccaaattgttctgctattatactcactcaaggatgtaggttgacagagctaataatgacacactcaaaagagggaagaaaaacatcataaatgatacactggatcttatatttatcattcagaggtgacctccacgagttcacttttaatcacaaatattatggtcatatatcacttgaaaaacaaaaacacagaagtataatcctgtcatgtgtctgcaaagaaaacgagaaatatttggtaacaggaataatgactaacctctctcaaaaaaaaattacaagacagccactatcatcatttgtgaagtaaagaaacagaagctcaaaaaagtaagtaacgttaataattgacatgaagtcattaatccagtaatactaaaaactgaatactaatccatttctaaaacctttattttttcctagtattaatattttaattggaacttaaaggtaaaacattagactaatcatcaacagtttatgatgcaccatcaccattagcaaataaatggcgcttttcttaatggtatttatttgtacagtgcaatgaatattaaaaatttgcttaaaccaagaattagagtattaccaactatattcatctgcatgtctctattctcccattcccctgtctctttaccctcagagataatcactttcccataggccagacaagagccaatcttgtaagcagatgtttctaagtgcagcagtctcaggtctcttttctgcatactgtaaaactaaattgtatttaatttgcatatatcacattttccttcctaatatgaatttataaatgtcatgaatgatgttgacaaaccatgaaacaatttcatataaatacattttctagaagccacatataatagcaaatgaagtggatttaagattttaggttaggtctctgaaatgtacaaacagaaagaaggggaaagagcagaattgaaagaagaacatgggcaggaggtcacgtcaccagcatagcattcccagtcagctttctagagctaatgactgatatgacagaagaggcaaacaatcccaaatctataaaatataacattgttaaattctttatttttataacttataaataagaacattaatttccaatataccattgccctattattttccagtactagaaaacacaacaaaattttcaaatgatttacacaacgtcatatcaaggcaaactatagccatattgagacatactcatgatgtaatataagtaaacaagatgtcagtaagttgtgattctcccaagtatataaaagcctttcaaacttttatggcatagcgtaccttctttccttttttgagctaaaattttctactctgtatcactatatctattcctctgtctgtcctactcctagtcaagactcaactaagaatcaatcttcaaaaaaaaaaaaaaaacaattcagggaggctagctgaagaatgatttagttacctattttgagctcccatcatcttcttggaacactattttgatagatatatgagttttcttgtcagtatccctcactatgctgtaaaatctataagagaggtgttagttttctatcactatggtaacaatcaccacagacttaaaataacactaatttgttaccttatagttctgtgagtcatcagtctcattagcctaaaatcgaggtgtggacaggactatatcccttctgtaggtcaaaaggaaaatccatttatttgtctgctccggcttctggagacagccctgttccttgactcatggttcttcttcaattttatcagttaataacagttaattgagtaccactcacaacacgcacttattccatagtcacatttccctcagactttgagcttatctgctttactctttcattttcaaggactctaattattgtattgagctttcctgtatattccaaaataatcttttcaggtcagctgactggtgaattttatcttcaataaattctcatttgctatgtaatgtaacatatttgcgagttccagaaattaggacatagaaataattggggagttattattctgtttatcccaaggggcataaaaattatccagtgtttttaatgagctcaataaatatggtatttatcaatctgaaacaatcaagtttcagaacatgtctgaatctatttggtactgtggacagcatgagcaatattaaatgttagaacatctgaaacagatgaagaccttttatgtggacaatactcagatctacttgactaattagtacagtctcttaaaataattcctttagattaattccttcagataacagatgaggaaattgtatcccagacagacaccgtgattttctctatgtccttcatggaaacagggagactccccctccaccctgtgtcacattttgtaactcgcacaacataaaagatctgcttgaaccctgatgactgatggtctcatgaaaaaaaagatctttattttcagctttttgtaactatgtattttagacatatacattatgagactggattggggtaccaatctcagagagaaagtatgtattttacctttacatttttttatttgattacaatctagtaaacaagttaaagaaagaaacccatggcctcccaaataattgacagacatttacaattaagattattctttcaaaattcaagttttgaatttgaggtaagaaatatcccttcagaaatctcccacatttttgctgtatctacagtatatctcattatactcagttaagtcattcagtaataactaaaatcctaaagtacttcgccaaaaatttaaccagataaaaacaattttaaaaagtagctaatgaatttaagatagtgcctggcttccattttttacacttgtcaactagcctatcttttattatttaatttttatttatttctcaaagaactaaagtagatctaccatttgatccagcaattccactactaggtatctactcaaagaaaaagaaatcattatataaaaaagacacatacacatgcgcatttatttgcaacacaattcacgactgcaaagatatggaatcaatctaagtgtccaccaaccaatgagcggataaagaaaacatggtatatagacaccacggaacaccgctcagctataaaaaataacgaaattatgtttttttttgcagcaacttggatggaactggaggccattattctaagtgaagtaagtcaggaatataaaactaaatacttcaagttctcacttgtaagtggaagctaaactatgggtacacaatgatatacagagtgatataataaacaatatcctaccttaacaagccactgtccctttaattttatctcctgtatcccgtaaaaaggacgtaaaattcacaggtgagtactattcttaatgtctccaaaattaatagctgtgcttgatgttttcttatagaattgaaattccaaatatatgcttataaataaacgataaatccaaatttgttacattgtacacatgttgccactttgaaagttaatattattttcaacttccaaagtttgtaataatattttaagagattcagacaaacatgacctcagaagaatctatgaggaggcatacatattctttagccctagatatataaaatcttatttggtcagagagttaagagttataaagtatttcttggagccgagtctaaatttcttcattttgttacattaaaaggcaaaaaaaaaggtctcagaagtttaagtttttgagagaaaactacattctaaaattcatgtttgaggattatttctccataatttgacttaaaatggttattttaataaattaaatacaagatactaatgccaaatgataaggcaatagaacagttacatatttgacatcactacaaagatattcaatacattgagttgtttataatagtgaataaagtagccaaaaactaataaataggagtattcctctgagagtctggtaacatatactgtaaaatccgcaaaatgtatatgggaacaccaccaaaagaaacatgattaatgttgatgattctgaggttttcaaatagattcgtgtgtatctgcagccacccaaccacacattaaccctgtcacctgaaactatcactatttaacaaaaaagactaatgaaacaatgtactttcctgatatatggcactgaataaaatatacctagtgattatagatagatttttaaaagctggtcatggtggtgcatgcctgtagtccagctgatctggaggctgaggaaggaagatcacttgagcccaggaggtcaaagctgtagtgcatcacggtcatacctgtgaatagcactgcactccagcctggcaacatagcaagaccctgtctctaaataaataaataaaaaccagttagaaaacaaaatgagaaaattgagaaaaataatttatagttaatgttgcttccatctgaatgtgtaatttgataataaagttattttgcatatttaaacataatttctttaacaggaaaacagaaataaaatcagaaaaaatgtaaaaattggaaattttctgccttcctgataatttttttttttttagaaaatcagggcaaaacatttaggaatacttactattattgcaaaaatttaatatcatgggttcaaagacacttgagatatataagtatgtacctttaatacttttctatttgttaaatatagcttagtaaaataaatgaactaataaaattcctaaatgttttactgaacaatgatttttttccttgatgtttagatgaaataatataatacctacaaaaagatactaagtgatgtcaccctgcgtagcttgaataaggacatttactgaaacatttttatgaaaaataaacatatttgattacataatttatataccttttccctccagatgtttccttttttccttccttattcttgaaattacttataaatgacaggaattttatatgagttctaaaatcagaataagaggaagagtggaagaattagaaaaagaaaaaaaaaatgccagttgtgcacttcttcacgatgcctttttaagagtcttagtgacatattaaaaagtacaaacaggccaggctcagtggctcaagcctgtaaccccagcactttgggaggctgaggtaggtggatcacttgaggtcaggagttggagaccagcctggctgacatggtgaaatctcatctctactaaaaatacaaaaattagccgagcatggtgatgtgtgcctgtaatcccagctactcaggaggctgaggcaggagaataacttgaacccaggaggcggaggttgtggtaagccgagatggtgccactgcactccagcctgggcgatagagccatttctgtctcaacaaaatgaatataataaaaattaaaatttttttaaaagtacaaacataatttagaaataaagttttgtgtgtgtgtacgtgtaaataaagcttttctaagaacatcatcataaaacaattgcatttgttttcatgaagaatccaagaaatgcacaaaataatcacttctataaatgcttatcttgaccacaatcaccacttattcagttatcttgatcacaatcaccacttattcaggaacagataagagatacaaatttttaagatctagatccagtagttattgaattaactactttctttctcaaagttttcctacaactaaactgatgatctcccttctaaatgtagcccctttaggatgtttatattagtgaatggccctattctaccttattacataccacttttcctccctttattccacttccactccccatttgcaataaatcatacacaggtacacatatgcaaacaccacacacacacacacacacacacactgctgtgtgtatctgtgtgcatgcacatttttctttatctatttttcaatctcttcacttgtctctagctccacttccacctgcttaaactactattatctctccgttggactatattgctaactgtttatttcacctctgatgttagttttcttcagtctttacacaaatccactctcttcactatagcgagtgatctgttttagaataaattgaatcatgatgttactatttctgcccccttcccctgcccccactggtcctgttccagctttaaaaactttaatggtttcacttagaatgaagactaaaattattatcattggctaacaaaccttggtctctacatacctcctcagtttcatcagcatttgatttacattggcctttattcatattgctatagtctgaatattttaactccccccacccataattcatatgttaaaatataaccccccaacgtgatggtataaggaggtgggctctttgggagataattaggtcatgagaccacagcccttatgagtgggattaatgccttataagaggccccgagagctgtctgtgccttctgtcatgtgagagcacagagaaaagaccactgtcaatgaatcaggaagtaggccatcaccaaacatcaaatttgctagcacctcgaacttagatttaccagcctccagaactatgaacaataattttttgttccttataagcagtttaaagtgttatgtttatagcaactgtctatatcaatttatagtgctatgttatagcaacctaaatggactaagacaagacacttgatctcacctcgcttacttctggtcatggaggcttatatattattccctccatttagaataaactccttgccccattatctttcatagtatctagcagatagtagagaccttaaaaaatacgttgaaagactaaataattaaatgaactgtcaccaaaagcaatgaatatatcagcatattatatgtgcattatcagctatgcaatgaattacagaaaattctgtttctcttactaaagacattatgactattccataccccaaatgatctattaggtcagtttagaggttacagtttattttacattgttttttataccttatatagttattgaaaatttattgaatataaataaaaggacaaaagttttacatttggtaataaatgcccaaaatataatttatataaaaagtatcagtctttattaaaatgactttgacccaagtttattctttataaacgtctgttgtaactctccaatgtaaagaaggcaaattggtgataaaattagttttgttttattttttgggacagaatctcgctctctgtcccaggctggagtgcaatggcacagtcttggcttcctgaaacctccgcctcctgggctcaagcgattctcctgcctcagcctcccgagtagctgggattacaggtgcctgccagcacgcccagctaatttttttgtacttttagtagagatggggtttcaccatgttggccaggctggtctcaaactcctgacctcaggtaatctgcccaccttggcctcccaaagtgctgggattacaggtgtgagccaccacacccagccataaagtttgatgaacctactctgacatatgttttttcatttattttagaagagtctcctcaaatgactttttatattaaacctgttcaaaacgatttctaaacctcaactctgaaaggatgctcaccaaatacttaaatgcacttcagaagtgaaagcaaagatatgttttcttcctacttgcatataatgaaagttaataatagaatcttattgataagtataatttgctaatacattcaaacacatgtgttgtcaaagttggtatacatatagtactgtgaaaggagagtctattttgatattttcccaggatagattatcattttgccttttgtacacacttttctgttgctctcatatgaccttaattgtttaaaaagtgttacttttttaaaaaatacatacttttgttctctgttagagcaatatgtatttggtatagattcagaaaaatatttgatatagattcagaaaaatattccatttgaaatctgggcttttaaatcacataaacatataatactagatgggtttcagttattttcttttttttttttttggcttagctctggttcattttttttaaaattttattttattattattatactttaagttttagggtacatgtgcacaatgtgcaggttagttacatatgtatacatgtgccatgctggtgtgctgcacccattaactcgtcacttagcattaggtatatctcctaatgctaaccctcccccctccccccaccccacaacagtccccagagtgtgatgttccccttcctgtgtccatgtgttctcattgttcaattcccacctatgagtgagaacatgtggtgtttggttttttgtccttgcgaaagtttactgggaatgatgatttccaatttcatccatgtccctacaaaggacatgaactcatcatttttttatggctgcatagtattccacggtgtatatgtgccacattttcttaatcctaacatacttttatatagtcaacaaatagatgaatttttaaaaattaatgccttagaagatgtaaagcatattcagtaagctttgaaaataactgaaacccaaatgtcctacaatcatagactgggttccagttattttcaaagcttactgaatatgcttttcatcttctaaggcattaatttttaaaaattcatctatttgttgactgtataaaagtatgttaggaatctttaacttgcaacatgtcatattacaatatattcactcaaggtcaacaaagagtatttattcttagttgactccttctggtattaagaacatggttgaacattttctgttttcaaagtactttatcttaagcttccagttacttgtcttagcaattccatcattggccagtcattcattctattgaacgtctctaatgacgggataaggctagaaaaaaagattcagaataacagtttctttgcaaagatttttcataatgtatcttttaacattgtattatggtttcaatatttgcatctcactccaaaatttatgttgaaacttaaacatcaatgcaacaacattaagaggttgggcccttaggaggtgattatgtcatgagggctgtgcactctgtaccttatagaagggctgaagggaactaactaggcccttttgcccttctgctatgtgagaacacagcattcgtcttctccaaaggatgcggcaacaggcaccatctttgaaacagaggccaggtcctcaccagacaatgaacttaccagtgccttgatctttgacttccagcctccagaacagtgagaaatacattatgttatctataaattacccagtttctgtttttgttgtggcaggatgactagggcatgtaaatattggtattatactcagaaaactcttagatacaaaattttcagtaaatgaaagatgcatttcttgctattttaaaatttgtaggttggcatgtctgtgtatttttcctttatacctaggaatgaagcagttgatatgcaaaaattattgggatttttggaatttaaattagctagccggtggtagagagatgacaagagtttagcaactgctgagagagacagagagagagagagaaatggtaaatagaaaagtgagaatagaagagacttgaatgaaacctattacaagaaaatgaagaatggagatagaataacacccacacacgaatgaaaaatagtaaaagcatttataagaaggaatttaagaaaatagacaaaaagttgtaggagatagagaaaattaaaaaaaataaaagtacagataccaagtggttgctgagttcctattatttgccagatactttaataaaatgcaacagagaaaatcaaagacaagatggacagaaatttgtaagaagaattgtagcacacagaatgaagtatgtagaaagtattatgagtgttctaagaaagaagtggccaatatattgtgcaggtttgtgtatgtttgcatgtgtgtgtaaatgtttttagacaaagaaaacattaaggaatattgattaatgatgaagaaacattaaatatgctttaaattgaaaatattattataacatactaacatatatttatcatttcttatatgccagaaatatactacacaattttcttgcataacattagttaatcctaacagtaatctaatgagaaagttactattattcttgattatggatagagatcagagccttagagaccactcatcaaaaatcatacattaatattttcaggatttgaaaatgttttatctgatttctaagctcatgctcttaactactatgccttaaatatttattttatattcacacactacatgttttatcgcatgttaatcctctgtttctcttttctttgtttatatgaaactataagatttgaatcatagttcctcaaaactatttcattcttaaaatctttttgtaatctattgcaggtgacacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatggtaggtcctggaaccaagccccaaggatattgagggacaactgtatttttatccccagaacttagcacaaaactgtcatatggtaaatttaatgaatatattttggagaaatagacatataataatattttatcacaacttccatcattttcctaaagttccagggggcggggcccacatcattgtacttttgtgattcctacaccacttattactaaggtattaaaatacaatgattaagagtgtggcagcatgatagggattgtattggatcagtagggcagtattaacaatattgagtcttccagtctgtgaacataggatgtctttccacttgttttcattaatttctttcagaaattatttttaatttttaatgcactaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaagagaatgcagtatatacatacagtggaatagtattcagtcttaaagggcggaaagaaaatcctgcaatatttgacaacatggataaactttgaagacattatgctaaggaaaataagccagtcacagagaacaaatactgcatactgcatgataccaatcctacaaagtatctaaagtagtgaaactcacagaagcaaagaatagactggtgccaggggaaagaatagaatggtgccaggggttggagagtgggagaagtgagaatatgctaaacaacatgtgtagatatttagttatgaaagataaaaattctagaaacctgatgaataacattatggtataaagataacaaatacagtattgttaaaaactttaaaatatttttaaaaggtagaacctctacttgactcttcttgcaaaaataaaaaaaggatttggcagcatgagccaggtgcctgagccatctttatggctgttagatgtaggatttgtgtgaaattaagcaagatagcttgaaattttaaccttctgtttccacatctgaaaaacaggaataataataaaattcagcttgtgaaatttttgtaatgattaaatagattaaataagatagtatatacttgattgaccattgatttcttcttcctttgccagaaatctggctcaccccagaaaatgctatttttctgtagccctctcactagtggtgaatgtttttatcatattcttccacaactaggacctgagttgggataggtcctgtttcttactccttcttccctattaccactgccctcttgcttaaaaacaaacaaaacaaataaaaaacacttggtatcatatcatcaaactgcctatatttcctcttcctccattctctcttgagccctctccaaactcagtttccttttcaaggttaggaaagtttggaaagagtttcaattattctttaaatttccaatattttaattcaaactggtatttttgtcaaactatatttattacatattaattccaaggggttcctctgataatctaaagtaaaatgtattctaagaaagagaaaattagaaggaatgttgtccagtgaactattgacactgcacccaacccagtacatgaaatgtgtattcatcactgacaacttgtggaattcattaaacaggacagcagcagtgcctttctccagtcagtgtaaatgtagtttttgagaggaggacaccaaaaatgtgacatttgaagacagccatgatttgattatgtgttttcttgttgctttggattgttatctgtctctatccaacataaaacaaaatccgcaaagatgagattttcatctgttttgttgtctgctatatacacaacaggtagaacagggttgggcacctagtagccccttaaaaataaagctatgcaattttgtataaagctatgtaattttgtgtaacttaaatgtaataatacattattaagtgtgttatctataaaatacaatgtgtgtggatgaaggtatatggtataaatacagagaagagtatttctaaggtgtttggcacttacaaataccacaaacgctagttgttattagaaacctgatgttagcataacaggtattacataatgcttgctatacttgaatgaatgaatgaaaatactcagcataaagcattattaatatttgtttataatgatatatatttttttcctggggagatatcatcagaattgcattccatgaatccagcagatcatgtgtggacaaatctttgatacaaccacataaaatattgatgactgtgttaacaatgttcttttaaaacattatctaagtctaagccttaacagatctcatcagtattccaattgttcaatgaagaaacatattaaatgcaaactagctgaacagtcttcactgagcatttagcggggcagcccttaggggcagtataggatcttacaagagtagggaacattaacagcatgaactgggccactgatgtcaggaacagccactgcattatgatccactagcgttataaacaaatactcagaaaggcagctaataatccgacatgagcaaagaagagaggaaatacctgaagaaagcatgaattcatagtttgagttttctacaaatacttttctaaataatacacaatcatgggataaatactaatttgatctgtaataaattacatatatgaaatataacaaaaatactcaacataaagcgtaaagaattattaatatttgcttataatgctctaatttttcctggggagatatcatcagaattgcattccgtgaatccagaagaccatgtgtggacaaatcttgcatacaaccacataaaatattgatgactgtattaacaatgttctttttaaacattatctatgcctaagctgaagagctctcatcagtattccaatttttcaatgaagaacaatatatatgtaatctataattacacatatatgagagattcagttagtgataacccatgatgtgataaattacacatatacatgtgtgtgtatgtgtgtgtgtgagtaaatttttagagattcacttagtattttgtctacacatataatttacctagatttcttgttttcctaacaggatgcaaaaaaggtacactgtggggtgggtaatatctccttactaaatatttattgactgattttgtccccacgtcattgaccagtgtcatataaatcaaactctcattacctatttttgaattgttgtttgaactccagctactatcctcaaagctcaccaacttgcccttctagctgacgcattttatgtctcaatctactttttattcaatgcttatttatttcattaatcacaaattgggtcattctgccaagtcctgaggaaaatataagtaactgagactgtctctgttcaggattttataatctaaccatgaaaacaagcattacatgacatattataaagggaaagatggacattaattttgattgggtgtcatcagtactaacattggagaacaataaataaattagtatcagtaataagtagaattttagtaaaatctagaacaataaacttttgttaaaattttacattataaaatcacaggacagcatgtggctatcgcatttcaagctgagataacagatttgctctcagatttcccacataatagttgaaccacaatgagaaagcaacttgagttccctgtttctttatagttccctgatctctaaactaggcataataatagtaaaatactaataattattgttataatcacaaggaccctatggagtacttgtgaacattaaagaatataatctatataaatggcttaattaataaattctaaataaatgttggtggttactattagtgactgatgcttacacataaaatgactattgatatgattcataatttcaagagacttcttgagtggtgtattagtctgttctcacactgctaataaagacatacctgagactaggtaaaatatgaggaaagaagtttaatggacttacggttccacatggctggggaggcctcacaatcgtggtggaagagcaagtgacatcttccatggcagcagacaagggagagaatgactaccaagcaaaaggggtttccccttacaaaaccatcagatctcatgagacttattaactactgtgagaacagtactggggaaacagccaccatgattcaattatttcccaccagttccctcctagagcacatgggaattatgggagctaaaattcaagatgatatttgggtgaggacacagccaaaccatatcaagtaggtaggaattatgtgtatgaaataagtaggaacattacttaatgttatatgagaaggcactaaatacaatcagtggcaaaaaagtgaaccctacaagcaatcaatcaagaataacttctaggaaggagggagaaagagagagagaatgagtattgttgtaaactggagttccacaaaggaaattgagcttataaatgagccctggatagatggattacgagaaagaaaagggcaaagagagaggatacagtaagaaaagcaaaaagactttaaaacaatatagacagaaggaaataaaatttaacattccaataatggaaaagaatacaatgtgagtaaacaattggtgtatgttgagaaattctgggaaataatatgagtaggcaaagcaagaatatatcacaaagggccaagaaagcttagatgtggacacaatccagtagatagtggaagaaatgttaggagatacttgagaaaagtactgttttaggaaatagagattagcggttcactgttttattaaaaatagctgaaagacagaagctgagtcacttcaacttctgcagtaagcaaagccatagtatgcaaactggcctttaaatccatgggggaatgtattatctcactttcatggtgcacatctatcatgggtaggtgaaagcaagggaaggagagatccactccacctagtcactcaaagataagggctgactgaggcattaccttttacagctgaaccatctgtgatacatatcttcttaagttgttctggcagaagagcgagaaaatgaagaatttcacatagatttttgttgcatcagcccaacaataatacgtcatacttacttatatttcactgcccagagatagttatacagttctgcctaataggtgaatatttaaacaactcatcagaacaaactgaatatttgcaaaatataactgtttcctacaaatgcaatgtgacaaaggtgtaaaattatttatttatttcacaaatgcacatggaacaccaaatgtgaactaagatttcaatgacaaaaaaaaaaaaccacacctaccttcccagttcttatatgcaaggaatttaatgtctaattccaattttcattgaataatctagactaagctgtcctaggaaaagggagtaaatgtagatagaaaatgacatattcccttgtactgccccatttatctcatcagtcattctgctttaaaggaattatctggtcacattttatcttctattcacatctgctactttcaggacctttctttccctcctctttctttgagattttcagttgctgctctgccttgtcttctgtgtccattcttagctccaatcctgagactcagctggagtctcagaggcttgcatctgagcactctgcattgctcagtgactaaggcaactgaattagggcagggacacctggaatagctcagtcctccacagcaggtggggtctgataaaagccatatgcctaagaccctgcagtatcaaagaactaagactcgcaggcattcctaactggaatctatctctatttcagtgttatgggctagattgtgttccccaaaattcatatattcaacctctatcccctagtaactcagaatgtaactatatttggatatagggcttttgaagagataattaagttaaaatgaggctcttaaggtgaaacctgtaagaagatactaggacacaaggagagacatcacgggtgtgcctgtacagaagggcaacaatgtgaagaggcagcaagagggtagatatctgaaagccaaggagagaggactgaggcaaccagctcaactagtaccttgatcttggataattccagtctccagaagtgcttaaatttctgttgtttaagccacctagtctgtggtatttaattacggcattcctagtaaaaggacaacttttatctctgtttccaataaacatttcaatcccatggtaggaaaatgacaatctgcctaatctctgccacctcctaacaaaaatcttgttttattaagaatacaaacaaaacatattttatataattttcttataattttattaatgtctgatgtaccagaaaatgacacataggtattgtatgctttgccttatttgaactcatgataaccctatgagagaggtagtaccattttcctcattttataaacaagaacagatgacttagatcaagtaacttgactctgataacatataggttaagtaggagagctcattcatctaacacggttacctttcatgacaatgatgatgaaaacagctaacagagtatccacgtgaccattattcatctaaaccccttacattaaataattggacattcataatattcctataatgtaagtattcctactagccgtgtgttatagacaaggaaatttaagcaaagagatattgagtaatttactatagccacagagctacagagttttggagccaggattcagatctaggcagtccaaactgaaggtgtgtatttttaaccaccacattctactgcttctcaaagtttggagtaggtatattagcatctggtaatggctgttgaggatattttaaaacttaggtaatgacttctgctattgtatacttttagaaaactggattgggatcaaaactgtccagtacatgctattttgttacctttggattcttttaatacctaaccttgtgcgattggggtcatagcacagcatgtatgatcatcattgctgcaaacggatacacatcttaaaagtgccaactcagtgttattcaaatttttcctgaaatttccatatgcttctcaagttccttaacttgaaaactcaaaattcttcctgcaaacattttctgattatctctactccaaaatgttttaacagttagtcaattagttaattaaaattttaattggcaaataattgtgcacattacatattttggggtacaatgtgatgttctgatatacatttactttgtgattaaatatgctaatgcacaaatttatcacctcataaacttgtcattttatggtgaaaacattcagaatctattcttttagtaatgttgaaacacacaatgcaatattatttattattgtcaccattgtgtgcaatagatcactgaagcttattcctcctctaactgaaatgttataacttttgatcaacatctcctctttcccatttcattgctcactccacccaccagcttctggtaaccaccaaccacatccagtggacagcaagttaaataataggaagttagagaaagctgacagttacaaaggatatgatgttatttaattgttcagaatatacaaaatgtgtttattataggatacagccccttatggaaaaataaatgagagtggggaaatttcaaaatcagacaaaagtaaaaagtactatgttcaccagaagatggagaagtctgataggaagacactcagaaaaggtcagtaaaaaacctctgagaaaaagaaagttgcaggaaaggtaaatcaataatgctgtttgctgaaatgctacaaaattatagtacttgtctaaggaagtagttactggaagccatagagagtgcactttcagtatagttacaagaaaaaccaaattgcagagcttaagggaattggtgaagaactggtagcaacagatacaaagatttgacagaacatctaactaaagaaaaactctattatgaattgtataagtcattgatgactcagagccaagcaagtttataattacatttttgctcaacttcgatttctatgaagaacatttaaaatgagttctgctttttcatacaattagaatgtgggcatttttcaatcgttctaaaattttcagattattagaaccacaaagacaagcatccaccttaccggatattattgattttatatgcattgcctggactctgaattagaccttttctttcttttccctgtctcagcaggacaaataagaacatctaggccaggagcggtggctcacgcctgaaatcccagtactttgggaggctgaggcgggcggatcacgaggtcaggagatcgagaccatcctagttaacacggtgaaaccccatctctactaaaaatacaaaaaattagccgggcgcggtggcgggagcctgtggtcctagctactcgggagcccgaggcaggagaatggcgtgaaccagggaggcggagcttgcagtgagccgagatcgcgccactgcactccagcctgggcacagagcgagactccgtcaaaaaaaaggaagggaggaagggaggaagggaaagaaagaaagaaagaaagagagagagagagagagagagagagagagagagagagagagagagacagagagagagacagagaaagagagaaagagagaaagaaagaaagaacatctgagcaccaatactgggatattgtaagttacctcagaaataacatccttgggtaaggggtgtgtgtgtggtggggtgtgtgtgtgtgtgtgtgtgtgtgtgtgtgtgtgtgtgtgtgttttagcagaaagagaatcttctaagtacaatgaaatgggcttctatttatcagtaccttttttcttctctctcttttagttctgttgctttccaggatatacacatggctttaacagagtctattactggaatacggagaagctattgaagtaatccttcaaggcataaggtcagaacttagagaagtcacagagtttgtatttctgaacctgattaccagaaaattcttctaaagcaggaaaagatatatgctttcaaactgttatcctacaaccaaatccattttggagacacaaggatccacaagattactcaccttcaggaaaacatgaagacaagaaatgctagtcttggtacaacctaatgaaaagacatagctgagatttcatatgaagataacattgagattgcttagaaaaaaattattggagttaacattgaaagtaacaatggtatttcttgtcatccctttctaaatggcatatatggtatgtaatctagaaatatgtacatatacatgtaatagcttacaaagcttccaataaaaaagacaaaatctctggattttgccatctaacgaaaacaatgtagttactattaaaacttgaatttaacttctcagaataaacatacagtcaaggtttttgtttatttctttgtttttccaacatggttgactgacttgggatgctagttctcggaaagatcaaagttacaggtgaatggtaatgatctgaatgaaacacagtcagatgagagccaggacctgtcagagaacccacaagaagaagctagggtacagaaaaagaaagcaggaagagtctggcagagattgacccccaaggaacttagagaccccaaaaaagtataggtgggggtgcttctctgttcccctcaccctggcaacaacctgctaaccatcgaattattagagagtccttctaccctcacaatcctgggcaatgatgtccgtggcaatttggaaaattcccaaagacagaaatccatgttgttaactcacacaggggtgcccacactcttctcaggcctgaactgagatgtcaagtgccgtactagttgtgtacacatagtgggccactgctgtgcctgtagaacctcagtcattgagtcaccacatcacaagatcccctgcaaacataccccataacctgctctgacatccacaatcaaagggaaacagagaggatccctgaggaactgtggatccctggtaatctagccctcagtgtgacctacccctggggaatgggggtgcacagacagccctccaaagcctgccttgagagaaaggaaatgtagtgtgacacagatcactgaagggagtggcaccggcagccgggaatggatatggagaggtagtcatcttctgctcctcccatctactcttgcagacacagcagaggctctaccagttaaaggccagcccttgtgaaattggtgtaaacttttccagtggttttcacaacagctacacctccattcaaagtaagcccctgccacagaggcttccatgaagagtaagacccatctctccccttctatacaaagaaatagcatcccagcaactgaaggcagacaagctacaaagttgtctgtcatgaacttggggaagaggatttgccctgagcccattttgttggtagctgccggaggggcatacccatggtctccagctgcactatggccaggagtcaaaggacaatgtatatttaaactgaaggtcatgagcaaaatgcaacagcggcatgatagggaagcagatcacattcctgtctgcccaggatgaggacctggtataggcctccaacgctcttccattgaaacattgccacagcccaacaggatctccaccagctacacctgtcagggtgggtgcctccagtcattactgagctaccagagaatgagcaggctcttatgcttaagtgccatcactggactggagagtaaaatagaatacctgttctcagaaaggcacagggctagtgaataagataagcttcctgagacctctgtactctcagcctcgcaggagatagtgtcagctgacacatctaacacatcaaaacaacaggcaacattcaagaaaaccaccatacaaagattacccacaatcaaggaacccataaagaactttggcacactgaaagcaccccaaaacaaagcatatcatacacatcataacataaatcacagtaatcctctaaaggaaaaataaatgatagaaaattcaaaaataagaagtgatatctcctttagatgagaaagaatcaatgcatgaactctagcagtacaaaaaggtagtagagtgttttgacatctctaaaggattgtacttgcactctaaccatagattctaaccaaaatgaaaatcctgaaatgacagataaagaattcaaaatacagagtgcaaggaatttcaatcagaaaaatgatgaaggatataaaaggcaaaatagctatattagaaaatagaacttcatgtattgaaaaagtaactaaaggaatttcaaaacatagttgaaagctttaacaatacactagaccattcagaagcctggtttttttgaattaaccctgtcacacaaatataaagaaaaaataatttttaaaaatgaacaaatccttcaagaaatattggataatggaaagcaaccaaacctatacttagaggaattcttgaggaaggagagaaagaaagaaacatgaaaaatataattgaggaaataattgaggaaaattttcctcatcttgtcagagaggaggacatccagatacaaacaatttagagaatatctgtaagatattatacaaatgaacattactaagtcataaatttatcagactatccaaggtcaatactaaagaaaaaaatcttaaacagtaagtatcaaactatctataaaatgtagtcccattagactaacagtggacttctcagcagcaaccttacaagccagaaggaattagaggtctattttgagccttcttaaagaaaataattttataataaatggcatccaaaatttttataacctactaaacttaatttcataaacaaagtagaaaaaaagtcattcccagacaagcaagtggtaagggaaattttcacccatagactggtccttcaaaaaatccttaaaggacttctaaacatgcaaatgaaaggacaatacttgctaccagaaaagcatatataagtacaaagttcacagatcccataaagcaattacacaattgaatatacaaagtatctagctaacaacaatatgacaggaataaaacctcacatgtcaatattaatcttgaatgaaaatggcctaaatgctccacataaaagatatcattttgcaaattggatgaaaaagcaagaccctaccatttgctgccttcaagggactgacctactgtgtaatgatatccacagccccaaagtaaagggtggagaatgatgtactacacaaatagaaaacaacaaagatcaggggtgctattcttgtatcagatgaaacagatattaaatcaagaaaggtaaaaaaaaagacaaagaaagatacaattcaacaagatttaactgtcctaaatatatgcacccaacaccatagcacccagattaataaaaacaactagacctaagaaaagaaacaagtcatacaataacagctgaagtatttaacaactattagttatataatctgtctggtgacagcaccagatagattatcaaggcaaaagaaaaccaacaaagtaactccagacttaaatggaactcttgatcaaatggatgtaatagacatctacagaacataccatgcaacaaccacagagtatacatttttcacatctgtgcatggaacgttctctaaaattaaccaaatacttggacttaaggcaagtctcaataatttcaaaaaaatcaaaattatgccagttatcttctcagatgacagaggaaataacattagaaatatatatcagccgggtgcagtggctcatgctggtaatcctagcagtttgggaggctgaggtgggtggatcatttgaggtcaggagttcaagacccacaaggccaacatggtaaaaccccatctctattaaaaatacaaaaattagctgggtgttagtggggcatgcctgtaatcccagctactcaggaaactgaggcaggaaaatcgcttgaatctgggaggcagaggttgcagtgagctgagatagcaccactacacttcagtctgggtgacagagtaagaccctgtctcaaaaaaaaaaaaaaatacatatcaggagaaactctcaaaaccacacaagtacatggaatctgaacaacttgctactgaatgattttaggctaaacaagaaaattaaggcagacataagaaaaagttgaaataaataaaaatagaaatataactcaccaaaactctgggatacaatgaaagcagtgttaagaggaaagtttaaagcactaaatgcctacataaaaagataaaaatatcttaaattaataatccaatatcatacatcaaggaactaggaacataagaacaaaccaaatgtaaagctagaagaagaaataacaaaaatcagagcagaactaaatggagttgagactgtaaaaaccaaacaagagattaacaaagcaaaagttgtgtctttgaaaggataaataaaattgataagactgctatttaagttaattaaggaacaaaaagagaagattctaatacgcacaatcagaaataataaaaatgtggcattacaaccgataccacagaaatacaaaatatattcagagtagtctatgtaaattctcagagagtaatcatggtagactatgaatatctctgtgatcaaaaacgagaaaacctagaagaaatgaataaatccctggaaacatataaccagccaagattgaaccaggaggaaattgaaatcctgaagagacatataatgagttatgaaattgaattagtaataaaaaatccattttccaaaaaaagccaggaccaaacagattaacagccaaactttaccagacatagaaagagctagtacccatcttgtataaactaataaaaatattaaggaggaatgactcctctctaactcattctatgaaaccagtatcatcctgataccaaaacctagcactgaacacatacacacaaagaaaactacaggccaatatccctgatgaatagacacaaaaatctgcaacaaaatgctagtgaaccaaatccagcagttcatcagaaagataatttgtcacagtcaagtggattttattccagggatgcacaaatagttaaacatatgcaaatcaataaatgtgattcaccacagaaacaattttaaaaacagtagccatatgatcatctcaatacctgcagaaaaaacattcaataatatccaatatgtctgtatgataaaaaccctcaacaaactaggcattgaaaaaaacatactgcaaaataataagagccgtctatgacaaacccacaactaatatcatactgaatgggaactgtaacaagacaaggatggccactctcagcaatcaggcaaggaaaataaataaatgtcttccatattgaaaaagaggaagtcaaattatctctgtttgctaatgacaatcttacacctagacaaccttgatatttcctccaaaagattcttttacctgataaactacttcagtaagatttcaggatacaaaataaatgcttgaaaatcagtttcatttacatagatcgacaacactcaaactgagaaccaaataaaaatctcaatttcatttataatagacacaaaaaataaaatatctagaaatatatttaacaaaggagaccaatgaggtaaaagatgtccacaacaagaactataaaacactgctgaaagaaatactacatgacagaagcaagtggaaaaatatcccatgatcattgtttggaagaatcaacatcattaaaatgactgtactgcccaaagcgagctacatagtcaatataatttctatcatagtaccaaatttattactcataaaattataaaaaaaaattctaaaatacatatggaaccaaaaaaagagccttaatagccaaagcaatcctaagaagaaagatgaagttgggggcatcacattatctgactttatactataaggctataataaaaaacaaacaaaactcagcatggcattggcataaagatggacacatagatctatggacacaatagggaaactagaaaataaaatcacatgtgtataaccacggttcttcaacaaagctgacaaaattaaacattggggaaaggtcaccctattcaataaatggtgctaggaaaacttgcttgctaaatgcagaagaaagaaacttcactcctatctctcaccatatgcaaaaattaactcgatgaattgaaaatttaaatttaagacctaaaactatagagatcatagaataaaacctaggaaaacctctttagacattggcctaggcaaataatttataaataatacctcaaaagcaaatgcaacataaacaaaagtagacaaatgggacttaattaagccaaagagtttctgcacagcaaaagaaacaattattagaataaacagacaacctatagtatgggagaaaatatttgcaagtaatatatctgacaaaagatttatgtccgaaatctataagaaaaacaaatcaacaagaacaaaacatataactccattaataagtgaggaaagaatgtaaacagacacttcccaaaagaagaaatggaagtgaccaacaaacatatgaaaaaacattcaacctcactaatcattagagaaatgcaagttacaacaaaaatgagacaccatttcatcccagtccatttgtactttttattatcatatatatcctcaaattcaaaacaaaataaaccacaacataaactgtgttagtatagtacattaaagtcagctccactgtgctgtatcacttggcaagtctgaaattccaatgggcttcagaaagttgactatgcaatgcccaataatgacctgataatctcatattagaggcaatgcaaatatatttataagactaagagctacaacaagcttacgaagaaaaccaatttatagcattacaggttaaaccagaagtgatttcctctgttaactaaaattacattactaaaaagtgcatggttcgtggatgtctaatgtgaaaaaagacagacagtgaatactttcctgctcagtgtgaacacttaataagaatgaaaatagaatgccttattatataaagtaataccaatacattgatttccaatctactcctctggcacaatttaaaatgagctcttgaactatagagtcacaactctttttcatttcaatgtgttttccttcaaaatagcagttatttatacatactgcttttaaaaatcatttttaggctgcagattcacaatctccataaatatcaaagatgtgaagttaagttcagatgcacttgaagtaaacaccatgctaactagcagcagtgttcaagagatcatgctgccgatcttatgaaagggaatatactattgtgaattattttgcaaatcccaaaagaagtttatctctcacattattgaagactgagaatgtcttaatatatgcacaacttgaacattgtttgtgaaaaagccagactaattcatctatcttctgatcaatcagtttagccaagcaaagcacaaaataaatgcacatcctttgctgccgttaagagcaaccagtttgcttgtctgtgcatcatgaatgccaaacaaatcttgaataagaacgaggaaaagttaaaagaaaagaaagacaggaaagaaataaaactcaattttcttgaataggaaatttctagggaggaaacattttccatttttgtcttctatcaaatttatatatatataaatatatatataacatattatatatatcctaactgtcattataggctattctaagacagattctgccaatattgaaatatctaagacaggcacaattgggccattgcaaacatcatgtactaaatggattctaaggaacctgaaaattaatgaatctttctaaaatgactgacttactgttaggggaaagcttaagaaatcaaataccaaatcaaataccaaaataccaaatcttttttcatttttctattcttcccaaaaaaaaaaaatagtgggggataaaataacgcaatgcccagttaaagtgccaacaccaaaacaacttatggctgctacttctgaccctttcagggggtcaaattttgttgtcttttgtatttctagctttgtttgagacctttgtttgcatatattcaaaggttagtaaatacaatttaatattgtttccacagaaattaagcatttacctagttagaataagcattcaaacagaggtcttgcattaaattttgtactaaactgtattccttctaccatgctgcaatctttattaagaaacaaaggacatctgatttcacttttctaagcttattttagttaaggttaattattacacagagatactaacctttcaatcataaactacaaattagcattattcatctctgtggtatattttcaatgtaataataaaaatcctggctcgctctaaaggtcaagctaaaagcaaccttaccatcatcatactggcccaagcagatttcaaagagagagcccaggatgatccctgaagctaaacatgtccagagataaaactgtcgaaacatcttctgtcaaagttcactcaaagctgatctgaaataagaaaaggtagaaagaaacatttgacatgttcattaatctgttataggtaaacacaattgtcacagcacagaaaagccttaatgacttcatagttaattacctgtgccacattatccattaacaaagtaacacactggtttaatgcactggaactgtttatcaacataaatttgcagacaagtaatctctaaggaaagacatcttttctgttatttaatttgccagcaagtaggttgagaagttaacatactaataatatcagaagcacactctttaaaatttaagacattatgggtaagtccaatgttaatcagtttaagttactaaacttatgttgtctacagcataattttacaacaaagtgtaagatagtaagccagttgttagtatcctacatgagcatttcaatgaaaatttgtcttatacaattaagtagaaaagcccatcattaaaatgttaattcctttctagtagagtgatcagagattgacttaactatgccaggaaagactaaggaaaatctgtcaattttcactacatctgctttatgaagcatttggatgcatttcattttaattctcttgttttacttttcaatccccagcaagttaaaaaaaaaaaaaaaagaaagaaaacaactgattgagaaattagtggcctgtgagcacatgagaatgtcttattgaaagaatgacatcctcagtttctttgtaaatttaggaaattatccacacagaattgttcaaaatgctcttgattataaattgtggcagactagggattggaacactgtttctctaattcagaggttccaaactcaaatgcctacagaggacaagcagacaaaggaaaagaatgaattagccaaaggggacaatagtgatggtagaggctgtgataaactgtgcaatgcaaggttttctaaagagaccagctggtgctcaacttctgtcagtggttgtgatgtggcaatgcaagccagtgtttctgggtcttctgattttcaaagagaaggcagaaatccaaattttcatgtgatttccaagtgtttacatgattgtgcaatcttctttataagactaaatgcttctagcaggtaatattgatgtctcaagttctccagttttctatttctgcccaggattctctctactagactagctgaggataaggtttatcagagggtacaaaggcacgattttaattctgcttttgtctacattttatttttgatttattgccaagtatttaataatgtttatttgtccagcagcatgtataaatatatatattgcattgtaaaattgtattaaaggtgtaagctctttttttaaactaatgggatacacagttcttgactttaaaagatcactgctctagatcacacacattttaatatgaagtctattcttctttgtttctttatctaagatataaaaggagctgccttctttttaactgggccttccacattttttcctaactggcaaagtgcttggcgcgtgcatttataatttctagggacagaaagcccaaagaagagctcattattagatgccaagagatcatcacaatccacactaacctgtagaaaaaagaaaaataaaattgaccaatgctactggttgtgtagagcagcggataagaatgtggctttttttttaaattcaagcttttcagcttactagttatatgactttgaagaaattaaatagcatctttgtctcacatttctcattatcataatggatataaaatagtatttacctcataagattgtcttaaacattaaatacgtaagggaatataaatacgtgcttaatgcagtgtacttacagaatgagtaccccctaaagcttaatatgagtaccccctaaagcttaatataaaagactcagcatctatggaacctccaaagtcttaaatacagatttactcaatctatctttagcaagggctggaaagtagatattattatccccattttgtggaggaaaggtcaggctcagagagaataagtgactggctcaaggttataaactggtgagtgtctgaagagaccataaagtctgtgagtaagacacttctgctcattccattagagaaaagtattggaaaaattcccagaaaacacagggctcagaagttttcaaggcatatggaggcccaggagagcctgctgtattgcttcccttaaactctgagagagacattctaacccccttcacaaaggattagagctctactaagatttctatatacaatggcttcaaatctttttttatttggaaaaacaaacatgacattaagaaataaaacaatgttatttaaattttaaaaatataaagagaaaccatatacaaatacaaaccagaaaggatatatattggaaaacaaaattaatacaaaccagaaaagatatgtattagaaaacaaaattaaagagacggtaatatcttagcaaaggacaaaaggacatagttgtgttcctgtgtgggtccttgatctgccagcttgacttcctttatagtagtttatagtattatgcattcacaaattatggcatattcttttattcctaactgaagctaatttggtttcatggaacagtctccaatataaaaacaacatgatggatcattattttaaaatcattaatgtcactgccattattatgcctccagaaacaaaacctcttgatctatggctctgcaagtttttagaggattatatgcatatttctgaaagcatcacagacaaaactcataaaaaatctatttagaatagatatagcatttactgcccagaggaaggagataattttaggggaaatattatacttatttgtctttgaataatgataataataacaatttctatagtttttttactctttcatctatatctgcctgatttccaaagaaattttcatcacttcaatgggctcaatatttacagagacctgaaagaaagctatgactcatcacatcaacccgataccccaaaacacagaacacatattgacttagtgagaaaacccagtttctaaacaaagatataatgaaaaggtacctcccacaaagagattgtgtaaatgactacaggaccaagatgtttagtacaatattgtgccaatcaactgacagcctatagtggcacttctgtgattgtgatcaaattaattggaagagatcaaatgctttagacaaaagactgtttttgttactagctttttaatctctagaattaaaagagaaagtcctataggagatgaattccataatcttgctaagtgactgtaggtaaatgaaaagcctgtcaaacaacacctctatggtggtactttacttttactacaaatcccacatcaaactctttccatgttccccgagtatatatttttcctacagaatttattggctaataatgttatgttctaaaaatccaaagcatgttcaattctaaaaagaattgtaggtgacctataaataaatatgttatacttgttttttaagagataattaaattggtgtattcagtactctaatatagctaataaagttatcattttgcaatcgtgacttagaaatagtattctgttgtcaaaatactggggaaaagtgtttttttcctattacagtataatattacacgtaagtggtttgcattccatgtgcattttatgacacaatttccttaggcttaagaatattttactgcaattattcaagacaaacatactaattttgaatttcacatcatttgtatttcctgcaagataaatctcatatttatttatctggcattcaatgttctcaaaaattaatttattcaacaagtacttatggagggtctactagataccactcactcttctaggcagttggaaaatatcagtgaacaaagctgacacatttcttttctcccatggatgttatattccagcaaaataaagatagaccaataacaaacataaataagttatataaaatgttaaaatgtaataagtgacatgaaaatagcagctagcatttcaaaactgtatattgtcactttacaataattttcattcagtaaatgaagtgagattacacaaagcaaccaaaatgctatccgataaaataactgaatgagaactttacaatgaaagtataactattccgacaaccctgacagcatccttgatggtatctactattctgagtacagatttctgtccatctcttggaaggagaataaaggtctttcactgcctttcactttcaaatataaatccaaagtctggaaatacacaaaggtctgtcctttttctgtttatccctgctccctgagtcttgggtgtttgcagtgacacatggcaaaagcagccaaggttgacaccacagcagttttctcttaaatacaattttgacaatgttaactattttttagcctatgtctctgactgctatgtgaataaacactaactttcttgagataccaaaacttggaacacaccgtcattactttgatgagaaaccccataccaatacacaaccatgaagcaagctggagtctcacagtgaagtgagctgtatgtatgcagtctgcccttcaacagttggttcagccaaattactgttattcttgatctgtaacaatatctagataaagctacaaaactaaaacttgtcactgctttgtattccttgtgagaaacgtatgctatctacctgctggaataaagcaaacttcccttcaaagcaacctcagcttcaaactaaaaacatgaggttttccaaagtcactgtatcttaccatactaaatatcaatttgcttaaatgactagagagaaacctgtcttctacctcagcatggtggtaaatattaataatgtcttcatcagtacagagggtacttatcacccttcagcattaccagatgaatcagctgttccttttttaaaatgtgtaatatgaagtttaggaaaataaaatttcagagagcctttcagatatattccttccttctagatcatattatatttttctttactaaatatacatatgtataagtttatatcatatattcatctataaaaatatattgatatttattgacaattttatagtacatttatacatatttatatataaaattatgttacatagtcacatatacaatttatataaagaagtatatattttatttaaatttacattaatgataggtaatatcaatgatattgatattatcgcccacttttttaaagtttgcaatttaaattcaaggggttccgttgtagctaatttgaggtaagtttggaaagtaactaatgtttttataggacactgtgaggtccaacctacctctcccacccggtcctgctaaattcggcttactagatctttgctcgggcttacagttttttttaacatgctactacatctgaatgtgtcttgactaccaaatttaaaatatgtgctaatttggccaggcgcggtggatcacacctgcaatcctagcactttgggaggttggggagcatagataactcgagatcaggagttccagaccagcctggcaaacttggtgaaaccccatctctactaaaaatataaaatattagctgggtgtggtggtgcacacctgtaatctcagttactcaggaggctgaggtagaagaatcgcttgaacccaggaagcagaggttgcagtgggttgagattgcaccactgcacttcagcctgagcgacagagcaagacagattccatttcaaataaaaagaaaatgttaatttgctttttgggtgcactctgtctcaacatatagattcatcctaaacattgtgggataaaataaaattgatgaaaatcatttttaaaattaagaatataaattattaagaactaatcttgctatcacttcaatcatttacaaggtctttcatttcagttttaaacattttaaatatataatcaacagttgtaaacattagatgagactaatttaacccaaaatatatttcccgaaaccacatgaaacacataaggtaagtccaagctctggcattcttatactacagctatggtgaattcttggagaattcaaatcagtgtcttaacatgtctgttgagtctattcattattaaattctggttttaataatagaactttaaataaaagagggaagaacactggttttctttttggggaatactacttctcaagaaaataaatgactgaccaatataattaatctgcttatgtttaaagattgtgtcttcatggaaaaaaactaatattcagtttagtctataatagatacatgccaaatgttataataatgtagtcatactagttggtttaataaaatataaatacaccaaaaatgtttttaaatgagtggaaatttaatctccatgtttactattgctattatattggatattttcttagtgtttatacatacatttactcaattagtatttattttatatttagtgcatatcagacactaagcttctactatagaaataaattattccatttcctcacaatgactttgctattgagcatgcactacatttcatatttttttacctaatatacatttcaaggtactttagtaaaataactccaaattaggagataaataagttttaattgccaatttttttgaggtttccattccatctatgttttcagaaccttcatctaaatctcagtcttttagataaatacatttctcactatttgttagaaaagtcatgggaaaaagcttagtttgaaaggagcaagcaaagggaaatataaaaagagaagcccaaacattatttcatcagtggagtgtttagcttaaaaatataaccaagtaaatttaaaatggagttttaatgctcaagcaaacgcatgcatcattttaaaaaagaagcttgaaagagagttctgtgcagtgttattacctggcacagaaaaatgattctgattaatattcttgtttgatgaatattatagattctaagaaacacaaataaattaatgagtaaatgagtattttcctaaggcaaatccatcagcaaaaaaaatccaaaagtattaagtcagtcaacagagactaaacgtaaaagtatgaaaatgtcagtgacttgtataatgtaatataataaaagtcctggctctggcatgagagagtcttgcattgcattcctagttatgttgcttttggagggctatataagggtaaactagttaaaacttgtgagaatcagtttaaaattaggacaataaaatccattttattcttctgtaattgacagatgaaaatttgaacaaaaaataaaagttaagaatattcatttgttcatttatagcataagtgtttactgagcactgattctggataatgcactttataagatgcagtggctacagctttatgagaaaaactaaatgaattaataataaatacataatagtccatatagagttttcagtctaacagagtgtgacagtcacacctaaagtagctcataatgaatcaaatcctcgtataatactattctatagatcaggggttcagtactggtccatggcctgttaggaaccaggccacagagcaggaggtgagtggtgggtgagcaagcaaagtttcatctgtatttacagcccctccccatcattcgcattaccgcctgagctccgcctcctgtcagatcagcagcagcattggattctcataggagggcaatctctattgtgaactgcacatacaagggttccaggttgcatgttccttacgagaatctaatgtctgatgattgatctgtcattgtctctcattattcccagatgggatcatctagttgcaagaaaacaagttcagagctcccactgattttacattatggtgagttgtatgattatatcattatatattataatataataataatagaaatagagtgtataataaatggaatgcacctaaatcatcccaaaccactctcctgctcccagccccaggtcggtggaaatttatttttcatgaaaccagtccctggtgccacaaacttggggaccattgccatagatagtggaatctatgacttgcttctaatgtgtagaatatgataaaggtaacaagatatcactttattgtttcaattaagttatataagattcagtcttagcacattggagaaagataaatcttcctgctctgtgtaaagaagcaaacgtattgtaaactgcctttggagaaggacatatgccagggaactccaggtgacttcttggaccagaggatggcctccagacaacagccctcagtcatataaccaaaaagaaatgaattctgccaacaatctaaatgagctttgtaaaacaattgcattccatattgttaattatattttgaaaagaaatgtaatttaaatactaaataatgagattttattttatatatgatcaattatatacaataaattattttcttataaatctagttacaacttttctgtttcttatattgaacaaattttgagctataactcagtcatattactttacttgcttttgccattaccatagcttggtaggaaataaggttttaaataatagtcttttaagtaggtgacagatttagaataaaagattcataacagttctaattttaaaaaatgacttcacatgtttaatgacatagcaaacaggtagtatctacattcctaattttttttcttaaatctgcttgcatttaaacaatgtaaaattaattggtaaagcatgtcatttaaaaaaaaaattaaattaaagttctgggatacatgtccagaatgtgtaggtttgttacgtgggtatacacgtgccatggtggtttgctgcaccgaccaacccgtcatctacattaggtatttctcctaatgctatccctcccctaacctccccacccccgcgacaggccccagtgtgtgatgttcccctctctgtgtccatgtgttttcattgttcagctcccacttacgagtgagaatatgcggtgcttggtttttctgttcttgtgttagtttgctgaaaatgatggtttccagcttcatccaagcatgtcatttttattagatatagttggtaatagaaggaaacatataacttttttttgttgtttgtttgttttgagatggagttttgctcttgttgcccaggctggagtgcaatggcatgatctcggctcactgcgacctcctcctcctgggttcaagcgattttcctgcctcagcctcccgagtagctgggattataggcatgtgccaccacgcacggctaattttgtatttttaatagagacagggtttctccgtgttggtcaggctggtctggaactcccgacctcagatgatctgccctccttggcctcccaaagtgctaggattacaggtgtgagccactgtgcccggccaacatataacttttaatagttatttaaatattaatatgtatgtaatggatactagagtaaatactgattgggaaatacaaactgtcattaataaaatatttgttttctatatagctttaatatgtactttttaacatgtacttacaacatttatttaacacgaatagagtagaaaatgtgtactttaatactttgccaggtgacatgtttaagtagaatgaataaaactaggtttatcctccattgcccctcttcttatcagaggggtcatatttcatatgtcatatcttttctacactttattttctacttcacattatatgaagtctaaccagagatcataaagtttcatactatatcaatgcagaggcagaatcaacattctatacatataactttttactttctttgcaggattttttaggtaaggtcttcggccaactgaactgcaactgtttcatttacaataattttaaaacagtaaaattctctcaagaactaagtttgtacatttgatgttgataaaaataatgctaatggtgaatattttttgagtatgatagatgttgatattattgaaatcattagatatgctttaataactttaaaaccaaatggtagactgttccatttcatttctctttgtactttaccaatttatactatgaaaatcatgtatgaaatgtatagtctagaacgtttgcagaaatatcatctcaaaaacagtaactcaaagtctaatacagaaagacatccatataaggaagcatttcacaaatatttctaagctttgatttgatatatattaagcttttaccatttatcttataaatctacatggttaaagaaatgatcaaccttctcaactggcacaatgtgaagatggataatttgacttagaaaaataactaattgtgtagtcatgtaagcccttcatttatgacacaaatccataaaggtcactgtcatatttcttagagactggattttaatgtaaagctgagttttatttttctaggaaactgtaacttttattgaaaatagttcatgtataagcagatttatggaattcaaactcatgttgtccaagggtcaattgtgtgtaattttataattgtaaaactctgtcttatctgtaaatgataagatattacaattagttggttctttatgtttgaggggcaaataaaatttgaataagttgtcttactcacaaagactatgcttcacgaataatacactaagaactttagtctcttcctacaaatacctaattttatagtgtatcctggcatttcaaaattaccaaactgaaaagtagtcgttctctctcttagtgtcaatgctaattgtatggtacgttcattactagagtacattttttctaacttaaatttttaaatttattacattaaatattagattatgctattatatagtaaattcaaactgcctgtataatattgtatcctattaaaatgatacagacattaaattttatgggcattctaatgattgttttccatttttccatacttttaaaataagttgttatatgtcccttggggatggggattattttaggaatactttactacttattaattttccaaaagtcaataatgaaaaatatttacttcccaacacaccctggcaagatattttataagtgaaagacataatttcattctgacctttttaattctaaggccttttcatgttgttttttttttttttttcaatctgatctaatttttaactctctctatttattaccataaccaaatttcattttactttatttttagctagttatttctgcctaggcattttctcctttttcatatttcgacctaagaatttgttcctcatgtaagacttctctgacaagtcacttcctcccccaagtataggtcaaatattttgcgataatccttagcctttcctttgtattcagcgaacacatctcagtttataattacattgcttgtcagtgggtactttggcaatatttgtgtttcactttatgcccctgagaagaggaatcattattagccaagctcctatcccagctttttatcccggagcccagcaaatagcttagcccagattagcattgatgttttgaatgaatgaattttaaaaagaaacgtatcattttcacaaaatgtcctgttatttacattaaagctaatttgttcttgtcaaatctgtattatatatgaaatttagttttaacacttattcctgcagcatttgctgaatatgcaaggatcgataattgataaattctaaggaagttctatttcctttaagacacatttaaggtattgttggagaaagggctatgaatattgtaaattctcacagagagtatggagatgtttgtacataaatatatacttattataaaataatattttaaatcgtcgaacttagataaaatatatgcttataaaatataagaataaaattctaatatacttggaaaataagaaccaaatctcagcctgtaagttaaaacttatggtttatatacaacaaaaactactggggctgtttttatttctgtgacccaattaaactaatcttttctcaaatttcatccctatgtctgagtatactaatattggcaaagccctctctatcctaaaataatgtctattttaatatgtcttcatagaaaagtcattaaaaagcagtgaacatagccactaagtatgattttaatatttttgttgaaatgactaaattaatagaaagtgacaaaaagtaccttaagaagaattttaaaaaacaaaaacaaaagattgaacaaagcatatgtggaaatataaattataattttcttccactttattaacactcttgtctaattagacaataattactttaaaaactaacactttccccttagaattactgctgaagttgaaaggttcaagtttttaattactgctcataaagcatgcagtgaaactttctaaactatgaaaagtctactatcttacgattcagcaagatatttatcttataaaaacatcattaataagtacaaaatctcatttaaattaacagcaagaaactttcattttcctttccagtgtcagagatgggtgaaataaatcaaaatcaaggatcttttgtggatgaaaggaagtagaaatcttaagactagaaactcactaatgtgatgcccatgggcaaagatgaaatcagatattacagatgattttgaagttgcagttttaataatgataaaggtatagtgaaagggagaattgaagcagaaatgaatttcatactgttgcccacaccaatcaactcatcatgcatttcaaaagtatattccggcacaacatggtggctcacacatgtaatcctagcactttgggaggtcaacataaaagaatggattgaggtcaggagttcaaagccagcctgggcaaagtagcaagacccagtctctgcagaatagacaaaataaaaaaattagccgggagtaagggcacacacctgaagtcctaccactctccagaggctgatgggggaggatggtttgagcccaggagttcaaggttacagtgagatatgatcgtgttactgcagggacagattgagagcccaaaaacaaacaaaacaaataaacaaaaaagtatattccactaataccttgtaaatgggggtgtatgaagtttttttaaatcagatataatgataatagcgtgtgtgcatggcagtgtgtgtgtgcgtgcgtgtcaggttgcatatattaagtgtaaacaccacagttatttcaggaagggatcataaatgcataagaatctaagtgtccataaaataccgtaaataaataattaaagctgattgagaaataatgggggctctggagactgtgcagaatttaaacttagcaactttgcagaagtctacgtctattttttccatcttccaattttttaggtaacattgagtgtctggattttcatatgcaattatgcaatttattttaattaaactattttctagtgtatagtgtggccaaggaaacgcagctttatgtgccatccagaccatgttgcaatagtttaaagccttgggcttaaggatctgttagtaacatgacatttgtatgatcagagctatctctccatacgcatttaggaccactgtactatcatcacgtccaaaacttcctttcataatcacaatctttgaaaattctcacactttagagtatcttcctgcctagaaaaatctatcacagtaatatatgcactcaccataaagataatgtaccaggatgctgaggatatactaggtggaaattttagaactgctgttgttcaggattttctcaaaagagaaatattcagaaatatcaggtagttactttacaaagtaacatatataaatatatgtatatacacacacacatatatttatatatgcacaaagggtttcttaaatgcacatgtacctttaaagtaagaatgcattttgggcatagtcatcaccaacacaaagttcattcttgcctcatgtattgatttatgctttaaattttgtaatcatgtgagcaatctttaaaatgataccagattcccaggttaaagtcatttggatgacatttatttatgttttttgtactattttgagtttgagggatggtgttagaaaatcttgtaaactagcttttggtattttctgattattattttttattttttggtgagcaacactaagactggcatttcaacttccaatgagggtccttatataatactcagttaagcatattactgctaaattcaaacaaattttaaaaacaaaaaaagatataaatgattgaaagcatgacaaacgttccctgtagatgttttctaatttttaatacattgaattaaaaatatgcctttccaagtgaattttagatattggttaccaccttcaagatcatcatttatgtatttgtgaaggtgaaagtaggaggcatacataatattatatctgtaataaatgtaactttttaaagtaacataacatctatatatggcaggaaataataatgatacaacattaaatagatatagacctgatgatatagttggaattctccaaactcttgcataacacttatgtaatcaatgtgaatttaaaaacatacaattggccgggcgcggtggctcacgcctgtaatcccagcactttgggaggccgaggcgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcgtgaacccaggaggcggagcttgcagtgagccgagattgcgccaccgcactccaacctgggagacacagcgagactccgtctcaaaaaaaaaaaaaaaaaaaaaacatacaattgacaataatatatgtgatatagtagattgtccaatattttgttggtctaaactacaaaatttgccctgatgattggtgtattgaagagaaaaacaattatttgtatctcatgatacttatcgaaagagtttgtagacaaataaaaaacacactagcaaaacacactctgtttcatgttaattaaagggagaaatactgttcacagaaattagcttccaaaaatcattcttcgtgaaaacacataagtaaactaattttaatactctcagttataactaaaatggtatcatccactatcttccactaactaagtattaaatacagagcataagctattccaactgacatattaaacaactttaagtatggcttatgtctataattttcttgtaatctcattctgaatggagctttcttgagcaacagtaattacagaggagttaagagtctggaaatagttatttgtttatagaaagaaaaactaataagagaatgaacatacttagtctaattagaaaagttttgtttaaactaccattagaagtaaaataatgccacaaactgaaatgaatccctggatattcttaaaacattattgttactttagtttcttaaaaacaaattaagcagacactcattttttccaatagcttgtaaacttttgaatcttgggtataattttaattcttgagagtgtcacatatttgataaagaatgtttgtctaagatttctatgcatatgtgtatttgagtatatgctatattaacatatgtgtattagactgccaagataaaatataactaatcaaagcatttattatttaactttgattaaatctattagcttctttacagattttgctcatttgtaagaggaggttaggtttcttcccccaggataaaagggatgagttatctgtttctcttgggacagatgtactgtggtaaatgcagtgataagagataaatgaaaataaagagaagcccctaaccaaacagaaatgaaaagaacaataatagaaaagagtgtctggggacagtgttcgaggttactttttcttttttctaaaatgattttttgcaattcatgaaaacaagcctgaagcgtaaacttgtcatctcattttaagatgcatttctcctaatattaggtattaaaatataatgatcaggcatatttttaagactcttttcaccttgtttgaaatgtattgcttcacaaagtctttgtggagctttctttttttttaagaaaagaagaaataatacaaatatagtttaggttgtgttaatgcttgaagaaaggtgtaaagggagtgatatgctttggttgtgtccccacccaaatctcaccttgaattgtaataatccccatgtgtcaagggtggggccaggtgaagataattgaatcacggggcattttcccccatactgttcttgtgatagtgaataagtctcatgagatctggttctataaatgggagttcccctgcacaagctctcttgcctgctgccatgtaagacatcactttgctgctccttcaccttctgccatgattgtgaggcctccccagccatgtggaactgtgagtcaattaaacctctttcctttatacattatccagtcttgggtatgtctttattagcagcctgagaacaactaatacagagagagaaagaaggttggagtagggagaagattgctagggtattaaaggaaagccctctgaaaatgacacttgagctgagacctgaataaactaagggatattttagagaatcccataacagggaagcaggcataccactttcaatggctctgagtggggagcatgccagccatggatgagaaacagcaaataggccagattaataagagggagggagtagtactagagatgagagacgtagccaacaagaaactgagagaatggaggtgccacttactggaatgtgatcctccctattggggagcggcaggtttggagtagaaatcaagagtttggctttgattgctcaaataaagtttgaaatatctattaaactaccaaatacagatgtcccatagattgatatgaatgaatctgaaagtcagggtagacaaaaaattgccagtcatgaaatgaacatggcactaacataggctatctacggaggatgtacaaagagagaaaaaatcaggacttgcaaatatttagaggtcagaaaaataaagggtatgtggctaaagagataagaaggagtgagagggaatgcctgaagccaaatgaagaaaggatttcaaacaggagagaatgctaatatgttgagtgccactaataggttgaggaagataaggattgaggattaactcttgtgtatttgcaaaacagaagtcactgatgcccttgagaagagtggttttagtggaggagtgggaacaaaagcctgactagaggttttcaagaaaatagagttcatataatttgttagtgtttttttttactgtgcaagtgagcaaccaaatgcggagataggaagacagtggggacaatgagtccatgaacttggcacatgtgtgcacttgtgttaaagatagagctattaccaatgaaaataatctattaaaaagtacagtgcagacaaaacaggagagagaatggacacacctgcacagtaagagaaaagtcctttcttaggttggtagaggaaattagatcctccagacagtggtaattaaccagagagaaggtccaggataggtggaagtttgcggatgagaaagatgtatcggagctttgaggataaagagaatgtatgaaggattcctttgaaaagtaatagtgtgaattaagtggcaaaatggcatacagttatacagttattgcatagggatgatggaccacttgatgtttgttttttcttttattttccagccacatgaagctgttggcatgtaggattagagtagacaaactactatttttattttttttatgtttagttttctttataatacacttcttcaagtttaccaattaaaatattttgaatctcataattaagtcttaaatatacgtgttcatgggtggtaattacttaaaacacttggatagtagcaagcaatgaaacttctctttctcttctgttgtattcaccaccactttagcctgaataactgagcaaataccaggttcttggaacactggcataaactatgtatctaggactatggctctgtccatcagcacaagccactagtaattcagaaattggtcatttatataatggcatttattgcatctttaccacgaacaatatgattttttaaacatggtttaaactatattatacaaataattcagctgtgtttgatacttcttatatgtaagaatcactttcctttttataggttacttttcctctttttataatatctgaaatttaaggatgctgtctcagagagccctttatttatgcaggcaagataagaatctatctgagatactctcacattcttaaaaactaaatagctacccatgtgtgtgtgcatagtgatgtcagaagttcttaactgagtcgtaaattccaaagaatcttagctaaaatgaagctcatatcttgctaattcttctctgttaacccataagaaaacagaagcccagagaaattaaaagatttgttcaagatttgcttgatagcatactaaggtggatttaggactttgggctctgaattgcttaatatggaagtgttgctcagggaaaagcccaaaccccagcattacacaataaatccatgcaacaaatttatacatgcagcctctgaatctataatttaaaaatgtgcaaaaccaagcatctttgaggaacaaaattctgagatattataagactttgaaagtcatattaggctttgctattgttcagattttttaaatatttttaatttttttcatttaaattttaagattttgttgtggtaaaatgtacataacatataatgtaccattttagccattttaagtttacagtttagtggctttaaggacattcacattgttgtgtagccatcaccaccatccatcttcagaacttttcatcgttacaaactggaactctatccattaaataggtgctccccattaagccctgctccccgcccctggtaaccattattctatgttatttctctattaatttgactattctgggtatggtatatttgtgaaatgatatgaaatttgtgctttcaatggacaagcatttgaggggattcaaaattgaattattttatcacgtttcagatggaactacaattattgagcatcaccattttagacattttactaggaaccttaaatacatgttttattttaaattctggatcaaaattctgaactaattgatttcatttctttataaattggacagaagctgagcatgagaggttaggtagccctctcaaagtcaaacattagaggcaagactagaagtggaatcttcaaacccatgtccattaacatttcacagaactttgaagtacattatgcttgcagtgattaaagcttgcgatcaagtgtctgactaacctgagttgcaatcctgactctgcctcttacatgctacaatattttgggcagttttctgaacttttcaaaccctcagtttttcctttgcaaaatgttaaaatgatagtttgaaaatcatctagaaagggtgttgattatagcatagcacaagacagaaacttttccatatcataaagaaaaaaatataggctttttgagatactaagaagattatcatttatatctgaaagggaattcagattgcttagggaaattatacctaagatgagactcacaatggcagataataataaaatagcgatatttttcacatattaaaatgcatgtgttattgtatataacaattatatatttaaaaattgtccttcagatatactcaaacacgtcttcaaataccttcatataaggatatttactgaagtatgatttgtaatacgaagaggttgtaaacaattagaatgtacagcaataaaggatacaataggttaaagaaaaaatgtattgtaggtatagaatatttgctatgtacctaattttttaaaatcatatttataaactaaaatagatactctaggatatgtcaaggagctaaggaaatcatttagtttactatttggatgtttacactgaatcttcaaagtgttacattttcttaaaagaaaatgttaaagcatatgtggcatttagtcaaatgtatatgaatatgtatttatggcctctttatgtaaatgcatatatgagatgttcttgaagtaaaaaataattctgtgtttttttctcttgacacaagttgaagctattacaaaagctaattatttaattaaaataacactggaaaaaatgttttaaatttcatttgttaagctagaaaatatttaagaagggaggaaataatttagatcaataccatgtgtatatttaaatcagattttcaaagtttgacctttttacagaaaatctaacagcaacaatcatttccagcgttactccaggtcaaatcatttgatagtgttatttcctatagtagtgtgtattagaatagaatgtctgaaaacttaggctacactaaatttataaaatgcattttttaaatagtaaactaactttagcttactgttgtttttaataaaatttttaatttttaacttttttagctttttgactcttgaacacatggtatagccatacaacatagtttctttctttatatttttattctataacctttttctattttaaaaattattaatttaatttttacttttaaagcattttttaaacctagacccaaaaatacacattagcctaggcctacaccgggtcaagataatcaatatccctgtcttcctcctccatatcttgtcccagtacaagactctgagaggcaataacatgcacggagctgtcatctcctatgataataatgccttcttctggaatatctcttgaagaacctgtctgagggtggtttacagttaatttttttataaggagatgaagtacactctaaaataacaataaaacttacagtattgtaaatacataaattagtaatataatcatttgctatcgttttcaagtactatatactaagtgtatgtgctattatttttatcactggcagcacagtaggtttgtttataccagaatcaccacaaacgtgtgagtaatgctttctgagatgatgttacaagggctatatcaccaggaaatagaaatagaaatttttcagctatgttatagccttatgggaccaccattgtatatgttgtacattgttgaccaaaatgccattatgcagagcatgaccatacaaatgtacagatgctcatcaaattacaatgaggatacatcctgttaaaatcattgaagtcaaaaatattgtaagttaaaatgcatttaataaactctgtctactgaacatcatagcttagcttagcctaccttaaccatgctcagaacacttgcattagcttacagttgggcaaaatcatctaatacaaagttaatttttataatagtgttgaatatagtatgtgactgattgaactgcactgaagtaaagtttccactgaatgcatatcacttggcaccatcataaatccaaaaaattgtaaattgaaccactgtaagttggcgactctctgtatataaaatatgtgtgtgtgtgtttatgtattttaaatcatcactgcctctacttttctaatttttgcatggaaatccaaatccaagggagcaagacagccaattttttttttttttttttgtatttttagtagagacggagtttcaccatgttggtcaggctagtcttgtactcctgacctcgtgatcagcctccccaagtgctgggattacaggtgtgagccaccgcactcggccaagatagccaattttaattataacccagagctaaaaatgtctagaaaattaaaatcatcagctaataaccaaactattatataaatatagattattttctagaaaagaaaagttcaaaggccatttaatagttgaaattttatgatgggtgcaaattttgatgcactatgttttgctttagatcctttttaaagaaagcattaaataaggaatgctttacagagttattgagattttttagcaaaaagaagtcctcattatttttgttttggtttcctgtgcttttggtgtcatatccataaaatcattgctgagacgaacatcatgaagcttttccctcatatttctttttgcactttaatgatttgagtcttacatttacgtcaataacctattttgaattttttgtgtgtatggtgtaaaattgtgtccaataccattcttttttatattcttatctatttttccaccaccatgtgttgattaggtcattgtgactttttggcacccttagtgaagatcagttgactatatatacatagatttatttctgagttctgtatcatattccagtattctatatgtctgttgtacaagtggtactatatcaaactaaaaaggctctgtacagcaaaggaaacaacagagtgaagaggcattttgccttaacagaatgggagaaaatatttgcaaaatgtatatttgataaaggtttgatctccaaaatactttatttttgaaactcctgtaactcaataaagcatgtgacttgattttaaaaatgggctaaagacttggaaagacaattttccccaaaagaactataaatagccaatagatatatttaaaaatgttcaatgtccctaatgataagaagaatgcaaatcaaagtcaacaagagatatctcctcacacctgtcagtatggctattacaaaacaaaaacaaagaaatcaaaacaataaaaccccaaagacagtatgtttttagtaagaatgtggagaaagtggaactcttgaaaactgttggtgggaatgcaaaatggtgcagccactatagaaatcactacggaggtttctaaaaaaatttaaaaatggaactaccatatgattcagtaatcaaaattcttggcatttatccaaaagaatcaaaattacactctcagatacaatcatatactagtactcttatgctcattgcgactctatttacaatatccaagatgtggaaacaacctaaatgtccatcaacaagtacatgaataaaaaaatgtgctacatatataatatatactgactaaaactctctcctttgaccaaaactttatttggactcttttgaatcttatgcttggctaggtctaaccttgggcttctctttctgtccttgttgaatccagtttgagcaagattcctgttaagtcagcttaggaaaaaagcttcaatatcttatgacactggactccattcagcaataattccatcaagttgatgtagctagaaacctcgtttttctgtatgtttcctcttagtaattttccattcactgaaccccaccctgctttttggtataagtctccacttgtcatggtggaagtcagaattgagtccaatctctctctgctcctttaagaccactttgctggggtccctatacctattaccatgcccatccttgaacaatatctgccttaacatctttaagaaaattctgcaatatataatacaatgttgtatggcagaaagtttcagtcaagccaggtaaaaaagccctagagatctgccaaacaacattatgtctatagtcaaagattatacacttaaaaattggttaagaggataggtctcacgttaagcattctaaccacaataaaataaaattaaaaaaatttaaaaaagtcttcactagcattaaaaattattaattataaatttattacagagctgtcctcaattaaattaaaaaataaaattgtcagcccaatgaaggcattatcttaaaaattagaattaatgtgcaaagagtagaataatgggagtggtaaaaattgaagttataaaagttatgttctaccctcaaccatcccattagttaggtaggctgggtaagtcatttttttttctctaagcctcaattgtacttctttagacttgggctaatcatactaaacaaatgggattgctattatgttaaaacacagacattaacaaacagcagttcaatctgactctggctaactatatactgaatagaatgcttaatgtattttaaccattctcacagaagtagaataaacaatataaacaataaatttccgaatccaaagtttaagagatgttaaggcaaatactgtattgtctgaaaagtatacacttttgaaaaatacataggattaatattgaaaatatcagaatatgcttaaacaagtatgcttacataggttttctcctttcatctcagtttgaaaatctagccatgtaaaatcagtttctagttaccagtgattcacagataagcttcacccattaaaatttccattcctacttaagaatcacaaagaagttaaaccccaaaagcagcatctcaaaatcaactctgaaaggcaattactttttcaataagtaaaattcatgaggaaaatttgtcactgcattagcaagttgtctctccatagaataaagaaccaaagctttacttgttcattgtgtatgagaagatcaggatcagtcagttaatgcttgtgttgagaacatttataatgtcaaaataaggttaataatcctaaaaattagataacttaataaagcaacattagactacctaaaaattccaatgctcaaaaagtaattcaatatttttagatatgctaaattgggtatctgctttctcagtaacgtttccaaaatacctatcttctcttcacattcaatttttctttcttactacaactctttagccacaactacataaaccttaaaataaaattttctgatattattattaatatatatgtccacataggtagataaaatggctataaaataggtaatttttaaagtttatgagctaagtgatgctaacagaagcaattctacaaatacatatgcaaagtgtattattcatttaaaacaattaacacaaagcactcttttttggatatggtaactaccaaagtcaaaaaaacaaagagctgaaatattatgtaaattgttcacagaaactgttgatctccaaaccagtcaattattatcacggcttgaatgttatataaaatggtagaaaaattcttgatcaacacttacattttgcctctgactactttcctcattaacttaccagccatgaaaagcactgtgcaaaagtcagcaattagggactgaataaagttttaagtggatcaatataacatatttggcatatctatgacacttctattaacattcatcaatttatgaaataacgacattaagtaattgtgttcatcccaaaaacccaaatatcaaatactatttgcatgactgtgttatacatagagcagaaggcagtgaagacatgatctttgcttttgtcacctatgaagacaaatatattgagtcacctatgaatacaatatattggagtgtgctctataagacaagtagatgccaactcctactggtcttggagaaaatgtaaataattctattggatgggagcagcaaagtaggtagcaatttcacagaatgggtggtattggggcatgttcttgaaggaatgagaggtcatcaaacagacaaaaacgttttgaacataggttataagcaataaagaaactgtggagttgcaaaaaatacagcatgatcaagaaattgtatagtcatgtgccacttaacaatgtttctgttaataatggaccacatatatgaggtgatcccttaagattggaatggagctgaaaaatgtctatcttctgttgacactgtagctgtcataacattataacacaacgcattactcatgtgtttgtggtaatgctggtgttaacctactgcactgccagtgtataaaaatacagcatatgcaattatatatagtacataatactcaataatgttaataaacaccatattactggtttgtgtatttacaagactaccttttttttttttttttttgagatggagtcttgctctgttgccaggctgggctggagtgcagtggcaccatctcggctcactgtaacgtctgcctcctgagttcaagtgattctcctgcctcagtctcccgagtagctgggactacaggagcacgccaccacttccagctaatttttgtatttttagtagagatggggtttcaccatgttggccaggcttgtctcgatctcctgaccttgtgatccacccacctcaacttcccaaagtgctgggattacaggcatgagccaccatggccagccacaagactatattttttatagttattttagagtatacttctcctacttattaaccagagtatttgaattttgcattttaagctgtggggagttgctaaaccagtaataactataataagaatatcaactaacgtttgtcagtactgttaatatcattcaccaacttttaaaatcacctattatatttgaaactgtttattatctcagtgtccctagaaaagcaagtactgcattaggtgcataagaagatgaccatcattgaaggtcaatgagcaaaatgtccaatttttttctcaacttggctgaatatgagacagaggagttcctctgagcaggtgagttatgtagcttatgacttacaaatgatccctaaaaacttcttatatggtatggtgtaaatgaaagtacaaaataatttatgacagtacgtagcagaacaaaagaggaaaatatgttttaattatcaattaaaaattacctccaaacttcaaatatgaaaacccacaaataaattgcatctctattgaaatagcacaggcacttcatggtttagatttgtagaaatgtctctgaaaactctgtatttcctacttttatgtttgtttatatttaggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagctataaaataaagtggtatgaaacaggaccgaaaatgctagagaaagagaatgatgagagggcacaggtcaaataataaaatgagagatatggaattcagaacttggttttcaatgaagatcatcgagattcacaacaaagtataaatgcaatccaagtaatctaaggaatctagcaaaatgacataagagctgaaagacaaaatattcatttataaaaggaacaaactgatctgatgaagctaaaaagctgactacaaaaattttgaaaaacaatcaaaagcactacacagcagaataggccaagctgaagaaaatctcagagctctaagactggttcttcaggtcaactcattcggattaaaaagaagaaaaaaaaaacagagtaaacaaaataaacaaaatctctgagaaatatgggattatgtaatgagaccaaacctgaaattaatttgcatctctgaaagaaagagagagattgcaagaaacttggaaaatatttttgtgggtattaacattaaccatggaaatgtctccaatattgctagagaggttgacatgaaaactcaggaaagacatttgagaactatactcaaacacttgactagatgagcctaacagatatctatagatttctccaacaaaaaacagcagaatatacattcttcttacctgcacatggtacactaaaatcaaccagatgattttccatgaagcaattctcaacaaattaaaaaaaacacatgcacacaaaatcatatcaaccacattgagaccacagcacaataaaaatagaaatcaatacacgggagatctctcaaaactataccattacatagaaatgaaacaatctgttcttgaatcacttttgggtaaacaatgaaattaaagcagaaaacaagaaattatttgaaactaatgaaacaaagatacaacataccagactctgggacacagctaaagcagtgttaagaggaaagtttctagcactaactgcccacatcaaaaagacagatttcacactaacaacctaacaccacactgacaggaactagaataacaagagcaaaccaatcccatagatagaagaagacaagaaataaccaaaatcagacctgaactgaacaaaactgagatgcatcaaaccatactgaagaccaacaaaaatatgttggttctttgaaacaataagattaatagactggtagctagactagaaaacatgacagaagatccaactaaatacaatgagacgtgacaaaggggatattaccactgatttcaaagaaataaaacaaaccctcagagaatctggtgcagatttctagtcacataaactagaaaaccttgaaggaataaataagttcctggaatcacacaacctcctaagattgaaccagaaagaaattgcaaccctgaatacagcattaatgagttacaaaattgaattagcagtaacaaaccaaccaaccagaataagccctataccagatatatttacagctgaattctacaaagtggcttaacaaaatctggtaccaatcctactgaaactattccaaaaaactgaggagggacttctccctaacttactctatgaggccagcattattctgataccaaaacctggcagaaacatgaaggtaaaagagaacttcaggctaattactgtggtgaatgtagatgcaaaaatcctcaacaaaatactagcaaactgaatccagcagcatatcaaaaagttaatcaaccaaaattatgaaggctttattcctgggatgcaaggttagttccacatttgcaacacaataaaatgattcagcgatccatcgtataaacagaactataaaccaaaccacgtgattatctcaatagacacagaaaagacttttgataaaattcagtgtccctttatggtacacatcctgaacaaagaagacatcattttgaatatacctcaaaatataatagccttctattgactgacccacagagaacatcatactgaatcggcacatgctggaagaattcttcttgagaactggaacaagacaaggatgcccagtttcaccaatcctgttcaacatgatattggaagtcctaaacagaggcataatgcaagaggaagaaataaaatgcatccaaatagagaggtattcaaactatctctgtagacaatgggattctatgcctagaaaaccccatagtccctgcccaaacactcctagaattgataacgtcagcaaagtttcaggatacaaaattaatgcacaaaaattgtagcatttctatacatcaatagtgtccaaggtgagagccaatcaagagcacaattgcattcataatagctgcaaataaataaaatacctagaaaaacagctaactagggaggtgaaaatatttacaattagaattataaaacactgctgaaagaaatcagaaatgaaacaaacaaatggaaatacataccatgctcatggataacaagaatcattatagtaaaaagggcatactgtccaaagctactacaaattcaatgctattccattcaaactaccaatgtcatttttcacataattacaaaaaactattcaaaatttacatgaaaccaaaaagagcctgaatagccaaagcaatcctaaacaaaaacaacaaagttgaaagcatcacactacctgactttaaattatacgacaaggcaataataaccagaacagcatgatactggtacaaaaagaaacatataaatcaatggaacaggttaaagaacacagaaataaagctacacatttataaccatctaatctgggacaaagtcaactaaaacaaccaatgggaaacaactccctattcaataaatgaagctgcagcaactggctagccctatgcagaagactgacactggatcctttcctttcaccacatataaaaatggatttaagacttaaatgaaaaacttaaaactatgaaaattcttgaagaaaatctagaaaatactagacattgtccctggcaaggattttatgactacgactacaaaagcaattgcaataaaaacaaaaattgacaagtgggacctaattataccaaatggcttctgcacagcaaaagaaactatcaacagtgtaaatagagaacctacaaaatgggataaaatatttgtaaactagacttctaacaatggtctaatatccagaacctataaggaattcaaacaattgaacaaccataaaacaaacaaccccattagaaaataagcaaaagaaatgaacagacatttctcaaaagaagacatatatgcagtaaacaacctataaaaacattctcatcatcaataataagagaaatgcatatcaaaaccacaatgagatagtatcttacaacgctcagaatgactattattaaaaagtcaaaaacaaagatcctggcaaggttgcagagaaaagggaatgcttaaacaccgctggtaggagtgcaaatttgttcggccactgtggaaatcagtttggagatttgtcaaagaacttaaaatagaacaatcattcaacccagcaatcttattcctgggtatatatccaaaggaatataaatcattctaccatgaagacacatgcatgcatatgttcactgcagcactacttatagtaacgaagacatggaatcaacctaaatgattatcaatagtggactggataaagaaaatgtcatacatatataccatggaatactacacagccttaaataagaatgaaatcatgtacttttcagcaacgtggatggaactggaggctattatcttcaacaaattaatgcagaaacagaaaaccaaatgccatatattctcacctatacatgggagctaaacattgagtacacatggatacagacaaaggaacaatagacacagggcctacctgagggtagagggtgggagttgaggatcaaaaagctacctattgagtactatgctcattacccaagtgatgaaataatctgtacaccaagcccccatggcatgcaatttaccttgtagaaaacatgcacatgtaccccaaacttaaaataaaagttggaaagaacaaatcataagaaagtaatcaaagtagaacccagatataaatccatgcattcacagccaactattttttgaaaaaggcaccaagaacaggaaatggggaaatgagattttcttcaataaatgatgctgagaaaactggataaccatatgtaaaagaatgaaaatggactcctatttctcaccatatacaaaaatcaaataaaaataaagacttaaatttaaacctgaaactatgaaactattagaagaaaatattgaaaaaatacttaacgacactggtctatgtaaagagttttctttgtgtgtgtaatatctcaaaagcacaggcaaccaaagcaaaatatagacatatgaaattacattaggctaaaaaccttctgcacagaaaagaaaacaatctagaaagtaaagagacagccagagaatggaagaaaatatttgcaaactatccacctggcaagagattaacaaccagaatatataaggagctcaagcaactcaatggcaaaaatagatgaaattaaaaatgggtagaagatctgaaaagacatttttctaaagagacatacaaatggcccacagttgtatgttgaacaatgaaaaattgttcaacatcactagtcttcagtgaaatacaactcaaaagtgcaatgagctattatcttaccatagcttaaattgattttatcaagaagacaaggaataacagatgctggcaaagacgtgaagaaaggagaactttgtacaccgttggtaggaatgcaaattagtgcaaccactatgaaaaaaagtatgacagtttctcaaaaaaattaaaaataaaactactatatgatccagcatttccactattaggtatacattcacaaaaaggcagtatattgaagagatatcttcactcccatgtttattgcagcactatttgctatacccaaattatggaatcaaccaaagtgcccatcaatgaataaagaaaatgtgagatagatatatatatatatatatacacacacacacacacacacacacacacacatatatatatagttgaatattgttaagtcatacaagagaatgaaatcctgtcatttgtagcaacatgatggaacaggaggtcattataagtgaaattagccaggcacagaaagacaaattgcatgttctcactcatatgtgggaactgaacaagtgactatcatgaagataggaatttgattattgggtaccagtggccaggaaaggtagatgggaagggagggtgaagagagtttgaataataggcacaaatatacagtttgagagaagaaataatatctagtgtttgatagatcaatagggtgattatagtttgcaatgattgatagtatatttcaaaatactaagaataatttgaatgtttctagcataaacaataaatatttaatggatatctcaattacactgatttgatatttacaaattatatacatatatgacattatcacatgtaacctgaaaatatgtacatctattatgaatcaatgcaaaaattggaaaaaaaaattaaaaataaaaataaatataccaacaatgctgtgaataaaggtaatcaaagcagcacagtagaatacagagagcatggaatgagaagcagacaaacttaaattcaaattcatattaggagacttctagctaaatgatcgggggcatatcacattaataaaaattattaacctccagagagccagagccagagacagagcaagtcagacacagagaatgaaaaaacatccaaactaccaatatccttatgaaagacgggacatcactatagaacttaaaaataacaaaaatataataaggaaatactgtaacaactctacatttgcaaattcaccaacaaatataaaatggaccagtttccttgaaagacacaagactcactcaagaaaataatggataacctaagacatgtcatatatttagtcaagcaattagatttagacttaaaaattcttccaacaaagaaaaattttgtctggatggactcactggggaattccactaaatgctgaagaaggaattttaacaattctgaacaatcccttccaaaaaatagaagaggaagtaacaactctcacctgattttacaagggagcattgtcctgatactaaagtcagacaaaaacatgatcaagtaaaacaatgaactaatctctctcatgagcatagatgcagaatttcttaacaaattattaacaaattgaatatggcaatatatacaaaacatactacatcacagtcaggtggagcagattccagtaatgagagcctgtttcaacatcagaaattgagtctacataattcttaatattatcagaataaaaagaaaaatcaatagattcagaagaaaagcatttgataaaattcaagatttgtttatgatatacactttcagtaaactataagtacttccttaacctgatagagtttgtctacgaaaacgtacagctaacattataatggcgaaagactgacaaagcaagtatatctcttcctcatcactactatagaacattgttttggaacctagacagtaaaataagacaaagaaaattaataaaatcctccagattggaaagaaagctctctctattaaaaagagaacatgattatctatgtagaaaatatctgaaatctcaaaaatgaaaagaaaataaactttcaagaatagcaaaagaatttagtaagtcacaggatacaaaaatcaactgcatctctgaatgttaacaatgaacatctttaagtcaaaaactgtaaccataccatgtacaatatcataaaacaattagatatttaggttaaattctaacaaagtatatgcatgatctatattcagaaaaatacaaaacacaaaagaaatgaaagaaggcctaagtgatgggtatacatattctgtgttcatgtatttgatgacttattaatgagataaattattcccaaattgattctatacatttccaattgaattcttagcaggatatttttagataccaaaaaactgattataagtttacatagaaaaggaaaataattataatatccaaaacattttgaaaaagaatttatttcaagatctcccactacctgatattcaaacttttttaaagttatagtaatcaggacagtattttattggcaaatgggtagatacacatatgaaaggaataaaataaatagaatataaatagaaccacacaaatgtttattttctgacaaagttgctttaaagacaataataaaaagacttaattttaaataaatagtgccagaaaaattagacctccaaacgtaaaaacaaaaatggaccttcacctgtacttcacattttttatcaaaatcaacagtaaaggatatagatataatatagaatgtaaaatgttaaaactttacaaaaaaaaacaaagaaaatttggaacataagtttaagcagccattttatagaaagaatatcaagagaaaaaacattattaattggactttaacacacttaaaaaaatgctctgccaaaaaacatatttaaaaagtgaaaagactagtcaaagattagaaaaaatatgtatttgtcaatcccctatctgacaaactgtatgcattcaacacagagaaagagcaattatgacacgataataaggaaaatatgtgggcaaagttcagtacaggcactttaccaaagaagaaatatggactgcaactaagcaaatgagaagatgctcaacaacagtcattaggggcatgcaaattgaaaccacattataatatttttttaaaggctaagattacaaagaaaacaaaaccttgttacactaaataccagtgaggaagtagagcaattgacacactcatgcattgctggtgaaaatgcaagataagacaacaactttggaaaatagtctgccagtttttaaaaagtgatcatttaactaccaaatgaccttgcatcaccacccctaggtatttacccaaaacagattaaaacttatgatcactcagaaatctatgcaaatggctatattgcccttattcataatggtgaaaaatggtaagcaatcgaaatgcctttcagctaataaaaagaaaaatgagctctggtaatccatacaacagagtactattgagtggtaaaaaaagaacgaaccaactattgatacctacaatccatgtggatgagtatcaaatggatatcctaactgaaaaaagtcagattcaaagggtcatgcatgatttaatttacatgacattcagtaaaaagcaaaactataagaaagagaaaattttgctacaaagcagcagcatggaagtttctttggggtaatgaaactatttcagtatctttattgtgatggtggttacaagactacatgtttgtcaaatataatatttcataccctaaagtgtgaattttactatataaaattcagttaaaatcattaaactatacatttcaacttattatatgaaaactaaatcataatacaactgacttttaaaaaacatctggtatattaaccactttattatactatccctttatagaaattctcatgttaaatctatatattttatgcatagaaaaatctacaagaaaagatagtctcaaaagtatatttgtccatgaggattttgcttttgaccaatttggttaattctactattttattatttgagtgtcttgaaaaatattctgtgtattttctgtgtcagtcagaatgattgccattctaactggtgtgagatgatatctcatagtggttttgatttgcatttctctgatggccagtgatgatgagcactttttcatgtgttttacactgttggtgggactgtaaactagttcaaccattgtggaagtcagtgtggcgattcctcagggatctagaactagaaataccatttgacccagccatctcattactgggtatatacccaaaggactataaatcatgctactataaagacacacgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaaatatactttctgaatgtcaagatctcgactttctttccttaggtcaaactgcattttagagttatccctcttgagcacttagaagctgcaataatcctggcaattggcaaactggagactgaatctaactctgtagcatgtgaccatagacaacagtatcatcacattatttctctaaaaaacagccaccttgctcttgataaatgctgtaattcccattttagtagacaatccttcctttcagaatcaggtttgccatttgattttatcaatcacaagtttcaaatgatcaataatccattagaattattttcaaaaaaatagcttttggaagatgatttcaacatatttctttctctctcacccaccccatcccccaacaaacgcagccctcagtatttataaatgtgccccatgctgctttcttggtcatgctatgaccatcaccagcattacacatgttgttgtacttatcttctttctaagaatacttcaatcatcatttagtacaaaataaaattcatgtttctaacaaaaactcttcttcatctcggcaaaaggagaactctttcctctgcagttgtgtgtagtttttgtatgagtttagtaagatatattagatggtacttcatagtagttacgtaggtctgaatataccttcttctactaggttttaaggttcttaaagacagtatatcagcatttttgagaaagaactttaggcgaaaattcatgtcccatatttttgttaggaactatgattctagagaatagggtgtgagggaaaaggagagtgaggcaggaagcaagcagggtcaatatgacaatgcattactgagctggtcactgatggcatcaggtataacgaatcacttgattttgaaggactgtcttcaaaaaggtcaaataatctctttccaggggggacaaaatcataggccagcttctgtttctctctgaattaaggtttaccagagggagcactaccttcctgtacaaatggattgcacatccatgagtgctacaagggtcccaaagcattacatgcctcagtggcagcactgaattctcacagaagacatgaaagaagcacagaaaggacctgatgttagacctgccgggtgcttcttatgcgaaactggccagaggtcactcatattcgttgctccaggtgctggcgctgacccagtggctatctgccctggatataggtgacactgaaagaacctgaagtggcacataagaggtgtctgattgagcatgcatttgtggtaaagctgtaaccataaagctgaagttcatctttgaatcacccactatactacaaaatggtgtatacatcaattattaaaatacttgctaaataaataagatttctaagaatgtataatggaaaggtaagagtgaatgctcacaatataggtgagcaatcctgcttacagaaaaggtaatgagttagtaaattccaaatgtatgaaattgaaaagagtgttaactactagtgtaagtacaaaattatacaaatactttgctgaaaagtcagggccattttcttattctaattttagtgaaaacagctgtgtgacctctctgggcctcactttttttcatctgtgaagtcaaaagcataaatttgatgacatttaagattttagtcaaactttgaaactgatgtgtttgaagttctgaatctatggcaaataaataattaaatattaatttattaggtatgattgagtacaaattgtgagttaggcacctctccagttcctaagaatacagtaatgaaaaagcagatatgaatactgccctattcgagtttaaatcctaatgtggagagtcacaaagcaaaataaatatctatgcaatatgttagaagtggggaggccagagaactgcattgcatgtttactcgggtggccagggtaggagtcactgaaaagctgagctgaaagatccagccaaatggataatgggggaggagcactctaggccattgtctgagcagggggtgaacttcacatgttctggagaataacgaactctttgacttgagccacatgatagaagttagagactgttatgaggatgatgccaaagagttaagaaggacagatcatgtagcaccctaggacattttgagaaatttgggttttactcagaatgagtcattgaggattttgagcagataaatgtatagcttgatttaggtttataaaaggatcaggatcaaattggctgctatattgagaatagattataatggggcaagtgtgtaaacagagatatggaaataaatagtttccaaaagacacatctagcataatttctgtaaggtaacaatgtggctaaaatgtgttttaatttagtatttttatggtcgtcagggtggttaaaaggttttatttattttaaagtaggtaaaacatgaatttactttacaaacatgtaaaaaacaactaataaaagttctactcaaactatttcaaaaaattgaagtggagggaatacttcaaaactcattctatgaggccagaattaccataccaaaaccagacaaacatgcaataataataataactataatccaatatctcttataaacacagatgcaaaaatcctcaaaaaacactagcaaactgaattcaacaacacaataaaaagatatttcaccatgattaagtgaattcatcccagagacgcaagtatagttaaacatatgctaatcaataaacatgatacatcataacatatgatcatttcaatagatgctgaaaaggcattccataaaatccaactttccttctttaaaaaaaaatttcctttggttattatcttgattaaaaacacctaacaaactaagtataaaagaagtatacctcaaaatagtaagggccacatctaacaaacccacagctaacataatactgaatgggaaaacattgaaagcctttcctctaaggtctgtaacaaggcaaataggctaactttcaccactcttattcaacacagcattggaagttctagacagaggaatgaagcaataaaagtgaataaagaacattgtaaaggaagaagtcaaattgtccttttttgcagatgatatgatcttatatttagaacataaatattgaaaaaaacctaaggattccactagaaaccgttagaactgatccatgaattcagtaaagttgctacaaaatcaacatacaacaattaataacatttctatattccagcagtaaacaatctgaaaaaaatacaagaaagtaattcaatttacacagctaccaaaaacaaacaaacaaacaaaaacccgggaataaatttagccaaaaaagtgcaagatctttactggaaaactggaaaagattgataaaataaattaaaaaggagacaaaaacatggtaagatacctcatgttttgggattggaagaattaacacagttaaaatgttcataccagctaaagtgatctacagattcaatactatccctatcaacataccaatgacattcttcacaaaatcgaaaaaaaaaaaaagctaaaatttgtatggagccacaaaagaccacaaatagccaaagcaatccagaactaaaagaacaaagctatagtatctaaaaaacagcatgatgccgtcatagaaatatacacataagccaatgtaacagaatagagaacccagaaataaatccatgcattttcagccaactcatttcaaaaatggtgccaaggacatatgctgataaacaaatacttttcaatgaatggtgctgggtaaactagatagccacatgcagaacaatgaaaatagactcttacctcttactacatacaaaaatcaaataaaaatggattgcatacttaaacgtaaaacctaaactataaaataactagaagaaaacattggggaaacacttcaggactttggtctagacaaagattttttgggcaagtcctcaaaagcacaggaaagaaaagcagaaatagagaaatgggattacactgagctaaaaatacttctacacagcaaagaaagcaatcaacaaagtgaggagacagtccacagaatgggagaaaatatttgtaaactatccatctgacaaaagggttaataatcagaatacataaggaactcaaataagacaatggtaaaaaacaaataatcaaattttaaaatgggcaaaagatcttaatagatatttttaagagaagatacaccagtaggtatgtgaaaataatgttcaaaatcactagccatggggaacgtaaatataaaccacaatgaaatatcatctcaccccagttaaagtagctataattaaaaagacaacaaataaccaaagctgatgagaatgtagaaaaatgtgaccctcctacattcttggtgggaatgtaaattggtacagccactatggagaacagtatgaaggttctactgaaaactgaaaatagaattagcatatgatccagcaattccattccttggtgtatgtccaaaaaaaggaaatcagaatatccacaaaaaatctgcagtctcgtgttaattgtactactattcacaacagccaagacatgacattaatctacgtccatcagcaaatgaacagattaagaaaatgtagtatatatacaaagtggcgtattaatacattaaaaagaatgctactctgtcatttgcagcaacatggatagaactggaggtcattatgttaattgagctaagccaaatacagaaaaacaaatatcccatgttctcactaatatgcgggagctaaaaaacttggtcttctggagataatgactataacagtggttatcaggggctggcaagggtagggtagaggatggatgaagaaagattggttaatggatacaaaaatatatatagatagaaggcacaatttctagcatttaataacacagcaggagtatagctaacaataacttattgtacatttaaaaatggctagaagatttggaatgttctcaacacaaagaaatgataaatgtgtaagatgatagctaccccaattaccttaatttgatcattacacattgtatgcatgtatcaaaataccatatgtaccacataaatatgtattattatgtaccaatattaaaagaaaaaatataaacagaaatatatttatacattctcttttttatatactaatatttaaaactaaatcatactatatactagtatacaaaaactatatattaatatataaaactaatacatataaaaataaagccatgcatacatatttagtaactaaaaatgtactctttctctttccaagtattatgttgtgtattcctctcaatgccatgaaataagtaatttttcatttacagatgaggtcacatggtcaaggacatatagaaagtgaaaggaaggcttacatattagtgaagcataatcactgatggcagaaaaaaaatgaagaatggggtggtagattcctattactgctattaccaatgactacaaaattgatggtttaaaacaacacaaatgtatcttataattttggaagtcagaagtaaaaaataggtctcactggactaaaatcaaggtattgacagggctgtgttttatctgtaggcttgaggcagaatccatttatttgccttttctagcttcctgagtctggtcacattgcttggctcatggctcatggcccccttctatctttaaaaccagcaatggccacctgagtctttctcaatttgcatcattctgacttctatttctgcttctctcttcgacttcaaaagaccattgtgattatattggacccacctcaacaatccagggtaatgtccttatctcaagtcacttgagtggtaatcctaactcaatcttcaactttaattcccacttaccatgggctataacatattcaacaattgtgaggtataagacattaacacctttgagtggctaatgttctgcctactacaaatggtgagataaatttgaggtgatgggatgctagataagtcttttcctttcctcataacttttgtcagaatctatgtgaatatatatagcagaatatgtaccatcactatttcaaggctatcccatttaatttttgttatgaggtcattgactctttacagaaaacatctaacatgtcagcgctttgtccttattattgtatttatctgtgtggtcatgaaagaagtggtctatgtgggagacttttccaaattatgaatctagaatacccataaatatttagtctcacttattcctacagtgtgtatgggtaagtgtattatttttcataagatgatggctggggaaattgggaatacagaacatgaagacagttaacatacgtgccagcctagttgttacccctcattatattacagactggtaaatgtatctacctaaatggaatgatgatgctactcaagactgaagaaggtagccttagaaaattttctaatgtagatcgttgaatgttgaagaccttgccatgttaagtgatgtagagaaaggtcctagaatactggctttctcctgaagagacaatagatttccactgatgacgtagagtgacacatcctgagtaaggctataaggattgtggagactgactttataccagggtgaagtcgggacatgttctttcttcaaaagcttttctttaaggcctgcattctagaaaggagagacagtcccaagggtactttcctaatgtcatggtacactagctcctgtgttaagttggcagcctggggtgagggaagaagtcttcgtcacaaagaatacattgcccagtaggaaaccactatggaaatttatggacttaagttattcaggaacagtcatattgcatactgagtttcaaatgaccttgtgtagaaatattcatcaatgtcttacaatattcaccataagtctggtaaaagttacaaactggtctttatctaaccgtttgaaaaaagaagggataggtgtccacaacacagtgcggagtgtttaaaagagagccatacaagcactaagaaagccagaagtgagtaaccagcagaaaagtagataaaggttctgatctggatccagatgataaatggaatggcaagtgaaaatcgggatatattttccagaagataaatgttcctggatatcttggaacatcaagtaaattattaagttcttatatataataaagcaagattgtagattcatctttttattcaggcatttgaggaaagtgtgacttcaaggactattgaaatctgagacatatgttctgggtacattaaggagaaggtatagtagtattgaagaatataaaaatatatttaggtctcgtaagtcagcacttctccttacattaactatatgactccttcattgtggattattattccatccaaaatttcctatttagaaggccacatttggttcatgcaaatacgaaaagatgccataatcggagaaaaaagtttggagatcatgaagatgcaaacaggagtatttcttaatactttattaagcttatacgaatacactaaagtacagttttaatttggcttctaagtatactttactctatacaaattaccaccacttgaaagaaaaaaagagagccagagatgaatatatagtttccaacataatatagaggcatagtagcatccttaacatgacatacactgtgctcctaaatactgctcctaaatattaaggataacatgctaaaatttgtctttatccccatgttttgggttataaaatattagatttagaaaaaagaaaaaaaaagaaagtaaaaagaaaccactctaacacaaggaattttattttcataaaacatccatatccatatactttgtaggcagttttcaaaatggctttcagtgatcctcttctcttaatattcatatcctgtcctttcagcttgatagttggcttgagattaatcacacttgagcttaatcacttccaagtctagatgacaaaagcctttgacttttctcttgcacattcttttttgccttcttatttattagccctgtcaaagctgcttctatgttgtgagatgctttatggataacatccatgtggtaaaatagtgaagtaggcctcttgccaaccaccagttaggaataaccatggaggaactgagtcccaccaacagctacttgagtgactataaaagtggacccatcactggttgaaccttgggataactatagcccaattgacaccttgattttagccttgtgagatattcagaaacagaggatgcaactaagcattgttttaatttctgacccatggaaactgagataataaatgtttgctgctttatccagtaagattttgaataatctgttaaacaaataaatagtacacatacatatacaaacttgcaagataaaacataactttagaggaaaaaaagaaatcaagcaagaactagatacagttaacataaacaaaactcatcatatttcattacagcatgtggaaattgtgaagtatctttttcttatatatgttaattactcagtaaaaaattagagtatcgctgaaatctgtataccaaagttgaaaaagacaaagaaaacttatagaatgtatgggaggtggtgaaaagataattaaaagattcaaaatcaaaatttatataacagaatttgtattttaagaaaaatgtaaagtgttacaaaaagtatgtctccttctctggcagtaattatcctatttgctataatataataaataggttttgagtaactgttttgtggccgatttaagcagcaatccacgtaaacagacacctggatttccttcagtaagggagcaggaaatgacaattacattcttcagcaaaaacattttatctttgtttacagacattttgtgtgtgtgtgtgtgtgaatgtttctcacaaattgcaaaggccccccaccagtcttaacaaagaatttatttgaccattaactatatttcatgcgtaacatatattttatgacatgaattatattttgaatttagatttttacattttgttaattactacttcacaagaaggggaaaaataaaaaatcttcaaaaagcaattatagctcaatgatttaaatcaattcaccgggttatggttgtggcagataataaaaaattaaattcttcttccaaagctaagttgattactctgagtacctacctgtgttcttccaaaattttataaattacgtgtgattggagctcagatgaaatttagattgctgattgactttaactataggaaaaactattcaaagaaaagattaaatgagaaccaaatccttttatatacacacagaaaaaaaaacatgaaagtgaaagtgatctaatcagaagtattacaaaaaatagacaagaagaaccaacagttatacgatctctctgataatggtaaattctctctttaagtaggcatgttgctattgatgtatgctgaatgagtgtgttttagttttccaacatagcaaatctgacagtgaacttgaaatcagttagactggtaaggggtttctggctggattccacataatgctgttggctcatgggatttccttggtctagccaggtttagaaacagtttttaatcagttaatactggatttattatgttaaagaatgggggagggtaaaactcactgattcagaaactggataatatataagtgtataatataaaattaatctgcagcgaaggccagagtgctttcaaatataagccagtacatttctttaacagtttccaaatgtctgggaattttaatcactaattatagcattaagtgagccaagaattttagaaaagaatatacttttattagatattttcttgaagatatggcagtctaacaaggaacaattttagataataggaaaacttattggaatagtagtcaaaatctccttcctgaactgtgagataaatacttaaaaatttactaaatccttcattcataaataattcttattttccacctattaatttgttaggtgattgaatgttatcttgcactcttatgtacaatagggtttctcaagcacagcactattcgcattttgggccagatgacaccttgttgtgggggtgtcctatgaattttaggatgtttaacagcatcctggcctttctccacctgctggatgatttgcgccctcccagttgtgacagccaaaaatgtttctaagcactgtcaaatgtccttttgggggcaaaataattgtctgttaagatatactgctcaaaaagaaagaggggaggagagcaggtagtggcgatggttaatgggtacaaacatacagttagatgaatggataagatctagtattcatagcaagaaagagtgactacagtctgcaataatttgttcacattttaaaataaccaaaagagtataagtggattgtttgtaacagaaagaaaggataagtgcttgaggtggtgattaccccatttaccctgatgtgattatcatgcattttatgtctgtatcaaaatatcttatgtaccccataaatatattcacctattatgtatccacaaaaattaaaaattaatgaaaggtttctatgactcatgtgcaaatataattataatcttagtggtcacaaccagtatatatatttttatccttcttgtgtcagggttccccaggaccactctaaagtttgatgatatacatattcacaactatggtttattacagcgaaaggctacacagcaaaatcagcaaagggaaaaggcttatggggcaaagtccagcggacaccacgtacaagtttccaagaaacctctcccattcgagtcgcacagatgagagtacagatggtccccaacttacaattttttgactttacattgggtttatcagagtattataggcatttgtgacttacaatattttcaacttacaatggttttataaggtgtaacaccactgtaggtcaagaaacatctgtgattcatagcaatgagttgtaacaccagttgtggaatgtcctctagataagttcattagagacttaatgctaactgcttagcacataccacatttccagactttcagaaataaagcaattgtttagaaaaaccatcattgtttttacaaactgtttaggtactacacaccatgcttatcagttagggaatgacgagatccctttcagaaatccaagttcccagacaccagccactggtcaactttgcaaaaagatcattctaatcacagcagtctcaggtctgttatgttaaccctttctctatgctttcctacaaaatgttttgtgacatgtcagctgcattttaggcacccaaagacttatacaataaataggtgaactaattaatcaaccagtgatgttttcagttagaattccttaaatgtctctattgacacgtttgttcctaaggactcttacacctacaaagaggaaaatgttccacataataaagcataactacagttttataatagaggaaaattttagttaatcaaattgtaccagcattaacctgcatttccagaaaagtcttcaaacaactcaagatccaatgggaggaactcattttcagtgaaaagaaaatgatgtatggtaatattctggtcgatgtaactttcaaatgcaaccactaagagaaagaggaatttaaatttcttgaatctaagactccatgaataaccattttctgtcaaggagccaatattatttttaaaaataaaatcactcaatggttacatttttttttttttttttgagacggagtctcgctctgtagcccaagctggagtgcagtggcgtgatctccgctcactgcaagctccgcctccagggttcacgccattctcctgcctcagcctccagagtagctgggactacaggcgcccgccaccacgcccggctaattttttgtatttttagtagacacggggttttactgtgttagccaggttggtctcgatctcctgacctcgtgatccacccgcccccgcctcccaaagtgctggaattacaaggcgtgagccaccgcgcccgaccactcaatggttacattcttatttgagatatggagttgtctagagcccttcactcaagacgatctgctttagattaataggatgctttgagaaaataaacttcatgttacttttgagaaaatatgatgcacattaattttatgataattaatgttgaaacacctcccataaccacacatccctcttttatacacgggataaaattgttagtttagattttattacttaattattgtctggtcatcaccccttatcccctcctgaatatttaatgagaccaaggtccgtgctcttttttaattcacatttgtctctccaggaccttgcataggatgtagtaaagagtatttaacaagaatctgttaaaatgatttttttgaaaaagctcagagagataactgtccataccccatgtgtccccacggtatattcgatctttattttgaaggcaaacactatattttaaaaatcaaaatctaataaagataaagcaccatccctttacaggattgatttctttgattgtaaagtgtgcgaaaaaagggtttccggtgcactctgacaccattcataaaatcctaaccaggacctggtaaggccttagtttgtcaacactgtaccagaaatctctaatataaacaggctcatattataatcttctgcatttgtaatttttgagaacagggtggaaaagcactcatttaagtggaggatttttcttttaaatgctgtacttgagaatgtatcattattccagatgagacagataagacgcgttgctcccttgccctggcagtggatttgtttgtatattatgctttctaactctctttctttgctgagctagctattttatgtttctttgtgaatgactgtaccttaagggaactatattctgtatccattattttataaaggtgagtgggctcagtaaatgcctgaaaaagtaccttgactaagatcacagagttaacataataaacctgatagtgctgtaggaagaaagacctagttaggtgtggagtaaaacttagccttataattcccaggccaaagtgtttccaccatcaccaaatcagcgtcagtaactaatcaaataacaatttatttaagccattaaaaaatgtaatgctttcactgcaatgtgaacatatatttaaacatgatgacgatttgtaaaaacaaagatttttagaactaagaagaaatatatattacaaagtagttagtattaaataaactgtttcctggatcctgaatgatgataaaagtttaccccattaacactagggagcatattcaaagaatccaaaattctagcaattctttggtttagtagaagccacaagaagataatttatatctgaaattctgtaatattacagcatcccagttccttttgtgaaacccagagttccatttactcattcgaatggctatacttttttagaatctcttcaaatttgttccatacatactttttagatatgaactaaaattaggcagagtaatatagttttctcctcaatatggaattgaaaaaagaaatactccagttacattttccagctgagtactttggcttattattggatttgattttacctttaacagtgatacaaaggcaaatgcaattgacaaagttaaatatgtggtagcagagtttgaagtttaaaaccctacgtgcttgcttgcttgcttggttttgcttttgttttcttgagcaattgttgactactcagcctgctctgtaaagttaagagcatagactctggagtatcagatgtagattagaattctatttttgccactacctatatttatgaattaaaacttttttttaacttccctgatctcagttttctcatactttaaaagaaatttatgtgtagacaaggaggggtcttactactctcattagcaataaataatattattacttcattgtcaagtttcctactacctaggtacatgaagcgcccttgctctgtctctctttctctctttctctcctctctttcttccagtttcctttatttaacagcaagttaaaaatgcagttggagaaatcaatttattattctcaaacaatttattttacatttataaaaccgtagagatggcttatattgtttatgtgacattgtttatccacaggataaaagaaaaagagttaaacagtaaataattaaaattgttagtttatccacaggataaaagaaaaagagttaaacagtaaataattaactcccacagctatagtcattcctctttaaaaactctagtcaactaaccaaaggaaacacctttttggtgaatacaggtaagttagggcaaagttttggtagtgaaattgtaaagaatcgattactactgtgatgaatcaaatcataaagaatttaacttcactgtactatacaatctattttcaagttgaaagttagttaaaaatgtttcactttattttctttgaagacaataagttggaggcaattcaaacattttattatgaattatcaactaagtttatttaaataatgaatttatctttatgcttaatgcaaattgcatatacattgtattcaaaataaaatgcaaataccaaagaaaaattgttttctaaaataatgttacaagtttatatttgtttcacagtaaattatttttaaatttttgtcagtttacaaacaaaagattgcttaacaattgcaagcagcaaatttaccaatatataaaattcaaaatgttcttccaaacacaaatataattaagcagcaataaaagcttagtatatgaactttattaatagtggttatatctagtttgtagttgccaagaagtaccagctttacatgcactggcaacagtaataaacaatttatggctttctaataaacagatacgtgttaaaagcacatttaaaagaaataccagaagagtttataacatttagcgagcatatggtctctataaagtagtaaattaagtactttataaaactgttagtattaatactatattacaatattttatatttgtgctgcatagttttcaaagtatcatttagaaggattctaatatttttagaacttatttattcttcccaactttgccagataagatttatctctactatgttgaagaattaaaactgagactcaagatggttaaaattttgactgacgtatttcaccacttggtaggagggccaggactcataattaggtttgtgtaattctaagtcaatgattgttccagtttatcttgctgttgctcaaacaggtgtgcttttaaatttgcttataaaatatgcacaaacagatggcacctgctaaatacataactggcaataatatcttgatattttcaaatactcaagagtaatctagcacaaagagctcagaaatttgcaacacaatatattgcacccagaaaaaacccttaaaaccgtctagttcaatcatctatgttagagaaaaattggacaaatagaattaaatgtctagccaatttactatctagaaaatttcaaagttcagactcaaaaatcacttctttgaatccatttctagagctttctgtgttacatcaagaaaacagatttttttccaaatgtttatgtttctttgtccaatctaaaggatgaaagatactaattctctgtaatacataagaagaaaagagaattagacagtatctttatcaagtcccatcagattagcaacaaatttacaaaagtgatgttataaaactttttgactaaaaggctttcccaatattataaaaagggtatcacattatactgccatttaatgctattaagaaaacattacctactacaaataaatcttaccgtcatgtttctcaatctattataattaataaaatattaggaaaagacttgttttattgtgaaaatgttattcaatatattttattccagataaatggatattaaaggatatttatagtactttcaatttgttctgaaagctacatctgtattatcaggaatatgtataagcactaaacattgttgcagaatttgtctaaggctaacaccattttcaacaccatgaagaataaaacaggccgggcgcggtggctcacgcctgtaatcccagcactttgggaggccgaggcggacagatcatgaagtcaggagatggagaccatcctggctaacatggtgaaaccccgtctctactaaaaattacaaaaaattagccgggcgtggtggcgggcgcctgtagtcccagctactctggaggctgaggcaggagaatggcgtgaacccgggaggcagagcttgcagtgagctgagatcacgccactgcactccagcctgggtgacagaacgagactccgtctcaaaaaaaaaaaaaaacaaaaaacaaaaaacaaaaaacaaacaaacaaacaaacaaaaaaaaacaataaaacaattttcctatatgtcagaaaaaacttctttacagcttttatgaagtgtataaatccctgcatgaatatattcaactcagtgactctattacattctttgatgtccctcatgtttctaaaaaaaatgatgccgagtgtatctttaggatttgaaagcaatgaaagtatataaagccaactgacaggacctcacttatttcctgctggtttatcagccgtcaggaaggatttgcactcaaactcttccacctttccccccttgttatcaatggcatacatggagccacaggaagagtaacgcatagtgtggccatctaaaacagggtaaaattcagacagtcttatagaaataaagtcacaaatgaggttcgaaaataattaccaacagacacaaaagaagaatctttaaaactccatgatctaaatatatattgacaatataattctatgccaatgagtagttttgaattcagcaccatatactgactgcctatttatcacatactaaagatacaaataagtaaggagttacccacatataaatattccatcaatgtttgcacatccatggtatatattataaagatacatctagcaccagaggatgttgggtgctatggaataagaaaatagagacgtgatttttttttttattttcgagacagggtctctgtcacccaggctggggggcagtggcctgatctctgctcaccgaaacctctgcctcccaggttcaagtgattctggtgcctcagcctcctgagcagctggaattacaggcgcatacaccatgcccagctaactttttgtatttttagcagagacggggtttcaccatgctgcccaggctggtctcgaactcctgacctcaagctatctgtccacctcggcctctaaagggctgggattacaggcgtgagccaccaggtccggcagaggcatgaattaaaaacaaacaaacaaacaaaaaaaaaaacttaaattacattctcaccccatcaacttatttgatcttaccaagtcatttcatctctatcttccattttttaaccacagtgtaaaaacatttgacttttcttcccactatattgttgtaagtataaaatgccacaatatatgtgaaaatggtctgaaaatcctaaagcacttctatattgctctatatacactagagcaagaagaggttaaatggtttcccctggtagcaccttcctgagcacagaaaggtgacctcggcaccagggtgtactggctcacttccctaaatctggaatgtaatctgaagagtattacccaaatcctttttctattgttttttttttgttgttgtttttttgtttgtttgtgtttttttttttttttttgagactgaatctcgctctgttgcccaggctggagtgcagtggcgccgccaccacggccggctgattttttttttttattattattattttttatttttagtagagacagggtttcaccgtgttagccaggatggtctcgatctcctgacctcgtgatccacccgtctcatcctcccaaagtgctgggattacaggcgtgagccaccgcgcccggctccccaaatctttactgccaagaaaagtgacaggtttagtaatttcatagtggtttggataatttggctttcaaatttcctttagattagttcctttagattataacattgctaacactataaaactctagtttgagtgaaattcttgtggattcagatactgcaatcaacgaacattgagccaaggatgaattggtgctattcctggtcaattctctttggcaaataaagatagactcgttccatgattgaaagctacataaaaaatatctaatatcactacatatcaaatataatttaaaatataaaatcaaaattaagtccttattaagccttggtagattaagaaaatacaccattaatatgccgacacacatctaattattaaattaaggaaaatttttgtatcaatttttgattggtaatacagaaataaattttcactacaaagaaattttgaataagtattgacactgatataaagtacatcatttaattattatcattattttttcaaattttagttatatttagaagattagattaccttagattccaattcaaagactatatcccatatgattatttcagcttttttcagaatgcattatttaaaaaacaaaacgtttatggacataaccaattataatgtgctgctgctcacaaaacaattgattataaacatgccagaaaaaatgacacaagtcgcatatgtgttctttccagattcaagctattatcttctaaatattctaagtagatagtagattaagataatttatttgccatgtttttcacacttagagtttttctttcttttttttttttttttttttttttgggagacagactcactctgtcacccaggctgaagtgcaatggcacgatcttggctcactgcaacctctgtctcttaggttcaagcgattctcctgcctcagcctcccagtcccttgccatcacacctggcttattttgtattttcagtagagacagggttttgccatgttggccaggctggtctcgaactcctgacttcaggtgatgcacctgcctcggcctcccaaaatgctgggattacagccttcagccactgcacccagccaggtttccctttatgcagaaagcagcttgcaggcaatgctaatattggtttaattttcttaggaggaacccagtatagtacgggaaataattaatataatttgttcttaaaaatatagcttagtattgtattaatttttctagagactgagccaaatcaagtttattccaactaaaatactgcaaacatttacttaagctaatatgtcttattcttaaaatgcttaagggtgcagctctagaattatatttcttagtcacaccttactgcaaattatattaattggagaataaatttatttataatcctagacacgttttaggaagagaatttgaatggaataaacagggaagagaaagatacatcttcttatgataaaataaagatactagagatctttatgacacaatagtaaacatatatatgaattatgaattaatctaatcatgctcatacataaagatctaactgtgtatttttcattttaaatcagttaaattagttacataatctactgtataagattaataaaaatgaactaaaaatatctgttggctcatcagaataatgcagcacttttttcattgggttattaaggataatatttataataataagtgcatacaaagttcttattacagtgcgtagagcacaatggatgctaactggatgttactttctctctctctatcgtgtaaacaccatgagacaaggcgcggtagctcatacctgtaatcccagcactttggcagcgggtggatcacctgaggtcaggagttcaagaccagcctgaccaatatggtgaaacccccgtctctactaaaaacacacacacacacacacacacacacacacacacacacacaaaattagctgggcatggtggcaggtgcctgtaatcccagctactcaggaggctgaggcaggagaatagtttgagcccgggaggcagagtttgcagtgagccgagatcacgccattgcactccagcctgggtgacagagacagactctgtctcaaaaaaataaaaaagtaaaaaataaaaacaaaaaatagtaaataccatgagtgcaaaaagaaaagctatcttattactgacgtgtccctatcctttatatagtgtccattacgtaataagagcccatcagtcatttttttcaatatgtaaatacggagaaatatcttgactacagtgcaggactccatgtttgtttggctctctgctcaaattagacttttcttccatcaatatagaataagccatgcatagacatagtttctattaaaaatctgtaccctaatgagtagaatgggctcacacagatcttggaaaaatacatttagtaggcttggtgaaactgtaatggctttgtacagaactccactgcaacccacctgacaaactaggatatgctaaacaaaccagtcatttatgtgagcgtgtgtatgtgtatgtgtctttctgtctgtctgtctgtatgtatgtgaaagagagagagagagagagagagaaactatggatacttcctttataaattctggctttgccttgccttagaacaggacaacagacttcacaatttttctacatatatgcaaataaattctcggcactttaactgtctttgagttacactttgatacatccacagtgcaatttatgtcaataaaaatgaaattcctaagtaggagggagctgtgtcttaacgtgattagtatttggacttcctattattgtatttgaagacagaggatgcttggctttatgaagcaagctcccaattggattaccatatgtctcaaaaaacatgatagtaaatgtcttttgatagcatgagatataaaggagaaatataaaaatttgctttatgaatgttctgcttccagccggggtatattcagttgtagttaagatagttgtgttctattagctggggacaatttgtaactgtccttattagaaacatacatgtgtatgccaaactgctaagaaatgagaaatttctgtctatatcacctgtttttggcttgctcagaattctaccttttttttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacggggtttcaccgtgtcagccaggatggtctcgatctcctgacctcgtgatccgcccgtctcggcctcccaaagtgctgggattacaggcgtgagccaccgcgcccggccaattctaccttcttaaaaattggctttcctttagaaaactacttcatttgccttctttatggtagtcacagtgctatgcccaccaacaatgacaagtaagagacctaaataagaccaattagattattccttaaagttttatttatgccgagagagagacagagagagagagaagggctcctttccttagtaattgcaattatgaatttaggttgagttgtcagcagccttaatatatagctgcatggacaaatattgactgagagttaaagccaaacatcatgggatgcaagcaaaaggcatcaaaagaaacagattcctcaggaggtcttattgggtctctgaatacagccatgcctgaaaaactcactgtaagacccttcattgctttatattatttgagctgcttttctttcccttgtaatcaaaggaccactgacaaatactggctaagtagaatattaataagaatatacacgaaaaagaaaaacatgaatatgcttttggtataaatttacctaaaatattttaacatgcaaattagataccatgtagtttgttaactttaatagttcctcaaattaaaatgttttagtatgtaaatacagatggtttccaactttaaatggttcgacttataattttttatttgattgtgatgtgaaagccatactaattcagtagaaatgtttcatcaaattttgaattgtgatattttccaggctattaatgtatggtaaaatactctctcatgatgctaggctgcagaccccagccagccacaagatcatgagtgtaaataagtgatactctacagtgtattgtgttgctgacgctttttggatattgtcttttcacatcccatcatgtttacaaaatggcatttttgacttacagtgttgtaaatgtatgatgtgtttatcaggccacaactccatcataaatcgagcagcctctatatacacaatatgtatataattttgagtatctcttcatattaatgtaaagttttattttacacttcatttgtggctacttttttcctttaaataaaggcaatgaaaccagatcaatgagagtacttgaattaattctagttgtagaaaagcttggatgatacccttacaaaggaaacccaaataaaaacctaaccaattgaacttttgggttgtgtttggaactatctcttttcaatgaattaacatgtgttatgtgtttatgatgacaaatattagactatattctttaaggcttatcatcagcaaagactttccgggttataggacttctctttatgatttcatctttccaatttttctgacttatgcctgtattttcttttatctttgcctcctataggtctggcttcttctgtcctctcatttcctggtctcctactgactcgcctcttatctctatggcatgtgaccttgggcatgtctttcagtgcctgtcattcttcttatacttcacttcctgtctctgccttccctccccctccatcttactacttctcagcatccttatatacaggtgaaataaaatcacttaaaattatcaattagatttctagtaggaaattgaaaagtactatcatcattttctttataataaagaatgtgacatgatatttaaagaaaattatttttagaagtgttcaattccacttgaacactaccgggcaaacacctaaattttcctttgttcaggttgcaaaatgtgagcatttcctaaatttgctgtgaaccctcaggaataaagcaaaaaacaattttcaaaataaaaatgaacaatttaatagatttaaatatgaatgtttcctaaaaaggatatattaataaagttctgtactaatatatataaatcctaaataaatttccatttcaatacttccttttgatatttctgtcttctctctcttgatatagaaacaacctgcatgtatgcagttcagttccttaggcatatatgattcattcatcttaatttagaaaatatcaaggccatgcctgggagcagaattggggcattatttgtctttcggcagcgtatttttaaaattgttatgaataagtaaattgacaaaatcctttctaagatgtacagacattttcaatcaataatgcacactatcaggacataaaatcttccctaactttttgagaaatctttacgttttctttagggaatagattcacacttaggttttatcacctatcctacactgacgtttgggggctgaactttttgaggtaatgggtgcctctgtacagctgcaacccagaatgattctttcactactatgccctgagcaaaaacagtcttgggttacaggagtgaattagtgccttctcctgtttcctgcaccctttatttcatgaccttatcccatgtatagggcgagtaagagtagtcagttcatactgatctcagcagatagcgatataaacagatacttggctcatagggcataacttacatttactaagaaaatgctcaaaaccattcattgaagtttttctatacagactttcaggaattttaatgagtacttgcttataaaatgttgacaaccttaatcataaagtggtaaaaactaatatgcaatgtatcaagggaacaatacctccaactgttttcccagaatatactttacaaattaccaaagcagataactgaccacatttcctttttaatttacctcactagttctttgaagttctattcaccattagctctttgaataactgttttaaaacagatgggatgaacatctggataacacaacatatatattttttttatcaattgcctcactgatgtgaggaacatctcctcccacacacaccaccctgtgcctcatctaatgtgttaacactttggataatgagaacaacagaagtggatactaaatatcttattcaaattaactcaaatctgagtgcaaatgtggaagtatccatgcaattcacgaactgctgccccagactgtgtttttaacagcagtgtttgatgatgttggcactcttgatcattttctgtttttgaagttactgagttcaatgatccatcctttgtgtttatttatcaggactgtgaacatcacaaacaatttgagatgtttagaattaaatgttgattttagctggcagaaaaaatgcaaagttaggtaaattgatgagcatcattttcatgtatatattatctctttgttaacagttatctttcccagacataatggaaatggctgaggagtatgggtaaactgaagtatctgagttcaaatttatgcatgttaagatagaataataaacatgctactcttctgtgcagaaattcaatgccaaactaattcatgaaatactgtacaatactatacaatacaatatagttcaactatattggctcgaatcaatataactggtagtttaagtcactggtagttcaaagaaagaccaactagattctgagcctcaaacagcattattagggacttgcctgcctctttgtctggcttcctctacgatggcttacttttcaggctgggtttcttaataatgttggtaaatatgatcacaacaagctctaaaattctacactccttgcctttctgcctgaatcttgcccccccaaaaataatttatttcaggcacttccagtccaaattttaaaactgatactaattttgtgtagtttgggtcatgtttatgacctactaattagtcacagttgccaagaaaccgaatgacctaggtaatatgctcaactctgaagctaggctatcaggttttgaaaccaatggattaagaacaggtaagtagctgggcgcagtggttcatgcctgtaattccagaacttgcgggggccaagacaggtggatcacttgaggtcaggagtttgagacccgcctggccaacatgggggaaaccctgtctctacccaaaatacaaaaattagcctggcgtggtgatacacatttgtaatccaagctactcgggaggctgagacaggaaaatcgcttgaacctgggaggtggaggttgcagtgagccgagatcatgccactgcactccagcctgggcaacatagcgagactctgtctcaaaaacaaaacaaaacaaaacaaaacaaaacaaaacaaaacaaaacaaaacagttaaggggtaattctccaaaggaaaactatcattattttatcaaactaatgaaggaagcatgctggtcagtcaaaccaacctgtgtctataatcaaagtgcaagctttgcagaggagcttttaatacataactgaaatattattcataagtaattggagtattctggggaatagatattagtaaaagttaaggaaatagaatgacaacaagtgataacaacatatatatatgtatatgtatctcctaacattagtctaaacatagagtccataccactgacagcaggcactggacatggttagaggaccattctccttaccataaagtgagaactcagatatactctccaactaatttaaccttgaatcacattttacctatgtatgagctatagcataatgtcagagcatattaatcataaccatatagcaagaatattacagattaaaattgtcatagcttatttttcttgtcttataagaaatgctaattagggtgaaattcatgttataaaagtatttacatataaatacttcaagaaaaaatttgctggagatattagcagaacatgtcgtacttaaaaaaatgcaagaatttggtctaggctgggttgaatatgtttaggaaaacacagtcttttgaagaaaaagtagattgcaatatctcaaataataactagtgacaatgaagaaaataaagtgttcttatgaacataagagttgatatttgtaacttttatggcatagctgatgaatcattcagtaaaaccaaatgaaacaaataccttcaatctctcaaatcaaacaccatactattgagattttagctataactttatgtttgtcttgtttgaaaaaatacttcaaaaccccaaaatattttttgttaaaccatcttacatggttaaaacattccttttagagtaaacacttatgaaattcttaagcattgtaacttcatcattctaaaggattaaaatgtttattttaaattgaacatttatgaaatgcttaagcattttagctagccttttttaaagtgcaatcataaaaacaatggttttataatgaaagaaatatttcataattgcattcatacatttgaactgtttatacatgtggcaataaaatgaaatacaattgtgaaacacatattttatataaagtatagttgccaatgtttttgttttcttgaaataatctttttattctttttcgcttttaaagcataagtttgtgtcacaatttaaattcattctagaaacttgcagttaatccctgattacttgtcatgattagatattcagctaaggtatacatcacagaccatctgtgagaggacactatttcatttgtcttctgggtaatagggaggctcattttgaggatgaacccaccctgctcttttgtgaaagcaggagagtgccaggtggttggtagagataaacacaaagggtaataccggggaaaaagaaacgcagggctttcccagcaaacctttacaatattggtgcactacaacaggtggaaaacagtgagatgtcatatatgtgtgcaaagccagaacacatttcacaatttgtagctcagattccatgagacactaagaatacagatgttaggaagtttcaaatttcaataagggtagaatgtaataccaccttgaaaataccctttctcaactgcatgtacttatattgctaactggagaaaataactctggagagtaatcatggaactgtgtggagtttatttggttaatgggaccaaacatacagttaggtagaagaaataagttctagagttcaatagcacactctaaggtgactagttactaattcattgtatatgtcaatatagctaaaagagaatatttgaaatgttcccaaaacaaataaataataaatctttgtggtgatggacaacctaaatatggtgaattgatttttacgtgtggtatgcatgtatcaaaatatcacatttactttttatggatacataagagttgtactatataaatatatatatatatagtatataaatatactatataaatatgtacaactcttatgtatccattaaatgtaaatacatgaatagattaacaaatagaacaagaaaaaatgattagtacagaatatttagcctttttctaagtttcatgagaaatctgcagatttcctagggaaacttatgatagcctattaacatgcaaatataacgtattagatctaatttttaaaagtaaaaagggatttttttaatcgactcgaagaagaaaaagatcttttaccatggttttcttgtcctgggctcaacatgtaatgatgaaagcaaactagaatagaaagtaaggcaaagaaaaataaatatatatttttttcagtggtctctaaatgtcttataaactttgttatgtctcttgtctagctttattccaggcacaaactgatcaaaaattggttcactgaatgagcttgccatatcagatatagaaattttgagatttgctaattcaaagtacaagaacacagtaaatagtaagagaatacatgagcctgtgagtatattaaattcactggcatgttttttcatctatttccctttagaatctattacaaaacctagagaaatgtgactcctatgaaccactgttatgcaaaggtgtgccagattcattgtgtttagggtagaaaatatagctgggagtaagaaaataaaaaataaagattttaattccaagaatgccccaaactaagtaaatgatgtattaccaaatttttattgctgcataaaatacctctttgtgacaacccagtttacaggcaatttcagtgttgactattagagaactattaagctgagaaggtcatgtagcatagggtaaacctcatgacctcatctgttagaacatgtgttgatacgatagaccaaggaaaaaatatgctctgagtaagaggtaagcatgcaggatcaattcaaaatggtcccagatgaagatgccttctgagtatatgtcagggaagtgaagacaatgaatagttccatgcaagcaattcaagtgagaaagggcaatgcgtaaggcaaaataaatgagataagaagcaactgttgccctcaaagagcctggtaagaggaagaatttttgtaagtcttgcttatttttcattagaaaaaaaatttagaggcaaatctttttatttaggcatattataaaaatatttctgtatcctaactatgaatgagaaaataagcataaactcaaattataaaaagatccaacaggcaaaaagctatgacatacaacatttgtttgaggttgatacttgaaaagaaattacccacaagttgtggagaaaataaatagaaatctgtttttctccactgctttaagaatctatactaatttcaactctcttagacaaaatttcacataggccacgtgcataaatatttttatgttgccattataccttatatggcaagtaattcctgtatccatactaactttactctgttgagctaaatacctttttagcaaaaaatagaatgtatcaaaatcgtaaatgctgacatttattgggaaaatggaataaattacatgcgctataattctcaaacctgtttagtgcaaaatatcttaaaagatgaaaaaagttcagagagagcaatcacaaatggatagaaaggaaaattcaaaatgatgtcaagaaaaaactggaatattagctccaggagagcaaaaacttttgtcttttattttttaaactactctcaccctggtacccagaattttgtttggacatagtaagcactcaatagatttagtgaatgagtaaacacattttaaaacatcaaaagtattacctgtattacagtgaaaaatacctaatgaccttctacaatgtgccattctttatgcaaagtactttatatataacagcctgtataatcactgttaaaaccacagagaaagataatcatttattgatgagaaattagaagttcagatctattaagaaagtcatccaaagccatgctgacttcaaagtacagactctttactttaggacatggcataacctccagagggtaatgatattgagaaagctttgccattggaaacacaatttcatagacaagaagagaaggttatgttcacattacttttcatgcttcacatggcaataacattctgatctttaatgttaggatttataactttacactaaatactccatgatctgttgtctaaatggtaacaccaagaatcatcacttttcctctgtaataagatgtgcagtgtctttgtgtgaaatatagctatatacattgtatatcttctagttgagaaaattaatcatgcaatgtatctggaataagaaaaaaatacagcaacaataaaaataggacaataaaatgagtaatacgtttaaatttctattgccagaaaaattgttcaaaatagaacttatgaaagagaaatagtgtagcacaaaacaacagcagaggagaaatgatgaaaacaatgagagaaagagataaattagtgaaataaagttgaaaaaagtttcattttaacatcattgcattttgtgaaaaaattttacacttttacattaaagagtttaagcgtatactaaattgaatttcttacttgatgcttctgctttaaattatatcaacgcttaattaccatttaaagcttattattagttaatttatatatcattactaatgtcagcatcttgtcaggcataagagttaaatataaatttatattccccaggtgaatgcaattgatacaagaaaaaaaaaaaggagttcctttctctaaatgtatcacatagtgatacaactttttatacactacaaatagactgggtcagaagttaaaaaaagtagtttgtagggccaggcgtggtggctcacgcctgtaatctgagtactttgggaggctgaggcgggcggatcacaagatcaggagatagagaccatcctggctaacacggtgaaaccccatctctactaaaaatacaaaaaattagccaggcgcggtggcaggcgcctgtaagtcccagctactccagaggctgaggcaggagaatgacgtgaaccccggaggtggagcttgcagtgagccgagatagcaccactgcactccagcctgggcgacagagcgagactccatctcaaaaaaacaaaaaaaaaaatctatccactatacacctttttgtgttcttaatataatcttcccactgaatacacaatcatatttactaacgtctataaccataaatgctatattttaacattatagacttagtagggttgttacttaaacagaatacatgacaacatcttcatgttctctaatctgcagacaccttttcaggcttttgcaaaatacgtaactgtttggctcaaaatttattacgagttcaaaaatatttttaaatactgaatacaaacagagagtattgaaaagctattttaaatattcaagaggactggagaaaactcctccattaattttaatgatgaaattaaaactgaacctattaaaactaaacctattagtcatcaagaatgatgattaaatgaaagtatcaaacagaatctatgagtccatgctaataagtgtttagatcaattaataaatgagggagtagaggaaaagcctcccatttagaagaattccaattaaattacatagacagtccacactaaaggagggaaagcataaatccttacatcttaagtgtgccctggtgtaagaaacttctttcctaagagtacagtatgggaagggggaagaacagtgacatcacagttgagaaatccgacaagtcctatttcatccaggagatcaaggtcaaatttaatagtcataaattacattggtagtatgtaccattgatacaatgtgaggaaaataacaaattccctctgtaatatacctcccccaagcactagtcttatcaataggaaaagcaccaacaaatcccaacacatggtatgtattctacaatatctgactagcatgcctcaatactgtcaaggtcatcaaaaacaaagtccaagaaattgtcatagccatgagaagcccaaagagttaggacaactaaatgtaacatagtgtcctggtgccaccttggtatagatagaagacattacataaaaacttaggaaatatgaataaactatgaatttcagttaataataacgcatcaatatttattatctaattttaccaaatataccatgctaatggaaaaatgttactaataggtgaacctgtatgctggggtcatacggggattttctgtacaatctcctctatttttctgtaaatctaatttttttctattaaaatgtctattaataaaaataacttaaccaaagagtctaaatatgaatgtgattatatgcaggtctgaagggcataacagcatgagagcatagagagaatgcaaattacacagtccagaggatttgacaagaagtcttcttgctttgcaataagctgcttgggcacacttagataagtcatttaagcctcttttccctggtttgctatgaaatgaatgaacaggactacaagagttctgaggccccactgagctctgttgtccgttgatttacctacaaaatgatgtcaccctcagagagattacaatctacttgagaaagtaaacttgctaacattgaaacaaatcaaaacatatttaggaacatagttcaaggctgggatcatattctatgtagttcatattctcaggatttcagagaaactaagcagcattatgaaatacttaagaagtaagcgagacttaaggaccattttgaaaaattggaaaatatgaatgaagaagtgaaggacaccccatatcccaaataattggaatctgactcttacagcaaattctccttttgcttcagttttaggttctgaatggggtaaaatattccttcaaatccctctatgctttattatcacatatagcatgaaacccaagtgccttacatggtgtatcccaccttccttgacattgtccttgttagttttccaaacccatgtcatgccacttgtaaagtgatctgcattagcacagtcctgagctgtctttagtttcctgcacagactatagttttagtttgaaacctaaatagtgttctgtgccaggacaggactctgtctgggaaagaagtgtaaaacttttggacttggtttggaaatgctcgttcattttaattcctcagtttgttttgattatctgagcctgcagaaatgatgcacccaacatttctctcaatcattcaaatgatttaaaacagatgaaatttttgtatataatatatcagatttcagtgagttgttaacttctgtataggagccaacaggaattttaaaaatctgttgttaaacactaataataatcaaagttgcaagacacttcatgttgagaactacaaagacacagccatagataaagttaacagcgacctggtgtcactgctcactccagggtgtaagcttattgaatagaatggcaggcatgcttgacagcagagtacgcaatgcctttttttttttttttaaatctcccactctttttctattttatcaagcatacataattaaatttgttaagtgaaaggatgcttaaaacacttgcagggatgtttctcaggaacatcctgagatttttttttttttcaaaaattagtgactttaaagaaaccagcatcctttgcaaactcaccaaattagtgtgtgcgtcaccaagatagaccatattttcttatgggtgggatgctagcatgcaacctgggatcccaaaatgtgatatatttacaggaaacatcatcacaaaatgccatgagaaagcagactgtgtacagaatccattctgctaaaggtggcatcagagcatccatctttgggaagtagttgtgacaaagtttctagaatccagtgcctgagggtcagcagtccagctctggtgtctgtatccctcaacagtatttcttcctgcataagccagttagggtgaaatctgttctttgcaactcagagcactgatagacaatccttcttttcttctggtgatacgtttctctaattctttagcaaatacctttttgtctgtagttctcaatttttggttccctccttaactgaaagtaaaaactaatactctgttgtccagtattgtagtctaaacacatatgtatctatttacattaaattagttcaaattgaataaaattaaaaatttacttcttcagtcatcctgaacgcattttaacggcttaatagcaacatgagctaccagcaacaacatcaaacaatgcagatacagaaacatttccattactgaagaaagttctatcagaaagagctgctctaaggcatagaaaatttgactagggcatatgtttctgcatctacatcagagaatccccttttaatgagttaactgattctgttaatggtttcaaattatgaccttgataccatgacatattacattcatctttcactctattattcattttgattttgcaagtaagtttacaaatgatcagattagattcagagctcattttgttagaataacaaaaatttaatctcattactactcattcctaaacattgaagttttcctcccagttaccttctcatgaatgatattaaactccagagtaaaatctgaaggctgacactaacagagccatccttttcagaaagtacatccaactatgttaaagtgttcattttagttcaacgatacctgaaatgcaggctgtgaggtggacatttaggatatgtacctgcctagcatacatttcccatccttttactaagagtactccaatttttgaagtctcccctagtatacaaagtcttggtacttctgtcagtcaagttattttctcactctcccctggccttgtgcttgacttaggaaacaattaaccaattggattatgctgtagaaacttacaaggagggaaattaaatgaagttacttaatctcaacgaaattacccaaatatatgctcatgagttccccttcactagacccccagagctgcccttattttgtccttcctgagttttgattgttcaaaatttactttgcatatgtgtcctcctgcaagattttaatgataatttttagattttgcttttagaatagccagttggcttttgcaaaagtattagatgatatcaatgtgcccatatttttacctacttgggaactttttcaaattacatctgttcttgatattctgaaatgccacgcttacccctttcttatctgtcttggtagcctaccacactattgacacactcatcatgaaccagataggtactttgaattcatctgcctgagaataatttaaccttcatggtctatttctgccaaaatactgctttaatacccccaatatttgttaactctatttgaagttaaatttctatctgtttgtgctttgagagatgttggcaaagagaaaggaggaaaataaactattttagataggcctagccttgtcaaatgtgttggagactttatagaaatcatgttgtcaaagtgatcaatttaaagaaaaacatacttatgtcttcttattttctgtatcaggatgtaactgaatatcttttggttagacatttgatcatatgttattttcccaaaccatcatttcaaggttattatcataagacaaatcactctaaaatctaatagttcaagccagtcagaattgagtgatgaaaatatacagctttatttataagtacattttatcattaggcttgaattggttcagacgtcatgaaaaattttgcatgctagtagtaattcctcaaactccaaagggattagagtttaacaaaattgccaatccaaaaaaaacaccaagcaaacagacatttattttaataagtacaaattacacataattataaatattccttatactaatatttaaactcagcagacagaggacaggttgaggtttgatttatattcacacttccgtcttaaaattttcaaaagacatcttttatttgcttacacatgaagaatgatcagtatcactatctgaatataaattaataagtgaaagtatctgtatatgtaaattcaggcaaactcaggcttaaaaatctaccttattgtaccacattgcaaaatagaaaggattgtaattctttataagtattcggtggaattaagtgcaatgcaaaacatgctatgaatgtcagctgttatatggaaaacatctaccagaaaagccacccatgagtccactcagataataatttttcctcttgtctgttttataagctgttgaggaatatataaaagaaatggaaatttacaaatttcaaataaatgaaacatacatatttttatagctatataatattacatacatttaaatagttacttgtattttattggctcttcggctacattccaaaacttaagcaagttaatttaggaagagccattaaatgcacgttctcaggcatattttcctacttgtaatgttcatgttcaaacatatttttcaatatgtaaaagtaaagtctttgtaaaataaataatttaagacattccttgtattataactgcattcagaatgtataatacaattatggcttggaaaaatcaccttaaaattttgtcttatctttttgttgtgcagaagctccactcaaaagaagacatacatgcgtccaacaaacatatgaaaaaaagctcaacatcactgatcattagataaatgcaaatcaaaaccacaatgagataacatctcattccagtcggaatggctcttattaacgttcaaagaaacaacagatgctggtgaggttgtggaggaaagggaaagcttttacactgttggtgggagtgtaaattatttcaaccattgtggaagacagggtggcgattcctcagagacctagaggcagaaataccatttgactcagaaatcttgttactgggtatatacccaaaggaatataaatcattctactataaagacacatgcatgcatatgttaattgcagccatattcacaatagcaaagacattgaatcaacataaatgactatcaatgatagactggagaaggaaaatgtggtacataaataccatagaatactatgcagcataaaaaggaatgagatcatgacctttgaagggacgtggatggagctggaagccattatcctcagcaaactatcataggaacagaaaagcaagcatttaaagtgggagctgaattatgagaacacacggacacatggggaacaacacatactggggcctgtccaaggggtggggggcagggagaacatcaggaagaatagctaatggatgctaggcttaatacctaggtgatggtatgcatctctgcagcaaaccaccatggcacacatttacctatgtaacaaacctgcatatgctgcacatgtaccccgaacttaaaagctgaagacttttttttttcttagagggagaaactagatctaaatgagtcataaaatacaaatgaatacaaatgcttaattctcctaatacgtcatttttaataaattaaaactatgcttatcagttcatgtgggattgtctaaaaattataaatgaaagatttaaattctctaccttcacaaatcaggtacagctagcattgatgtcattgagatttggctgatggtacatcattagattctataattaatcaccaacacctgcagatgcattctcaacatgaaattacttttgatatcacatggagaaggagagatctcactaaatcttttaactatgagtactttggaggtaacagagatgattgtcatcttgtcacactgagacatgttgattctagcacttttggattcttccatgaatatgttaaaccattaccaataggtcaataacctgcccttttcacccctgactagaaacactattttaaaagagttcttattgatttttttctagctgtttttatttttctcactttctaaaataccaagaaaatatcattcaatgctgcaaaaataacctaaagaaaaaaaatctaggagcatcatacaataaaaatgaactgatttcttatgaagtcagcttcaaaactgtgtaaggcccaattcttatctctgacaatctgttacttaacatttgctgcttaacacttcataaaagtcaagtctagatgaactggcatacttcataggctttttttttttttttttttttttttttttttttttttttgagacggagtctcgctctgtctcccaggctggagtgcagtggcgcggtctcggctcactgcaagctccgcctcctgggttcacaccactctcctgcctcaacctcccgagtagctaggaccacaggcgcctgccaccacacccagctaattttttgtatttttagtagagacggggtttcaccgtgttagccaggatggtctcgatctcctgacctcgtgatctgtctgcctcggcctcccaaagtgctgcgattacaggcttgagccactgcgcccagccacttcatagtcttataaataatttactgtaatactcattaagggcagtaaaacaatcagcagttactacacactgacagattcaagtatagagtgaatgagatactatgtatctactatatcttgaaactaaaacataaataagtgtcacaaatttaaaatatacatttaaaaaagaatagacacacacacaagcacacatacatacaatcacatacacatccaaacacaggcgtattgttatacatgcatataaattaatattaaataaaacttatgttttaacaaactctgtatacttaaattcaccagtggttagttatcccaggcagtattacctactaagccttagggaccattattttcatttaaattccagtagtaggtaaaacctaaatgtcaaaacttagcacaatgtttaatgagtggataaatattagaaaccacgtctcctgaaatcttaggtaagtcattattaggggcttactactttcagtacctgacatttactcctttttttcatattagttttattttttattaaatgtcctcctgccttgaagataatctatttaataaagaagaaaaaaaagtgcttttttactttgaggtttacttgaacataagcatcacctttgtaattccacacaagcgtcacctttgtaatttgtcctttaagacaattagactgttttatatcaatgtattattaaacttgattgcacttatgcaggacatattataaaagaattatgagggaagtacacagatgctgttagagtctactaaaaaatagattatttactattggaaacccaaaggagagaatgcctcaaaaatgtggtaataaatacctgtgggaaaatcttaagttgaagaataatcctggacataattttatttactattgttattatatctttatcctaacgagattaatgactgatgttttcactgcaatttcagttaataggaactctatacaatgaaattgcttgatcaactgatagttttttagtttattgttttattgacacataatagttatacatgtttatggagtacatagtgatgtttagatacacacaacgtatagtaatcagatcagggtaattagcatatccattatctccaatatttatcatttatttgtgttgaaaacatttagtatcttctagctatttaaaaatagatattattgttaaccattgtcattctacagtgctataaaatattagaacttgatcattctatctagctgtaattttgtgttccttaacaaatatctcggccgggcgcggtggctcacgcttgtaatcccagtactctgggaggccgaggcgggcggatcacgaggtcaggagatcgagaccacgaggaaaccccgtctctactaaaaatacaaaaaattagctgggcgtggtggcgggcgcctgtagtcccagctactcggagaggctgaggcaggagaatggcgtgaacccgggaggcggagcttgcagtgagccgagatagcgccactgcactccagcctgggcgacagagcaagactccgtctcaaacaacaacaaacacataaaaaaaacaaatatctccacatccttcctttccctctaacctttccagcctgtagtaacctgttttgcattttacttctatgagatcaacttattttagcttctgcatatgagtaagaccatgcagtgtttaacttttggttcttatttcacttaacataatttcctccagttccatccatgttgctgcaaatgacagaacttcattttttatgtctgaatagtatttcatgtgtatatgtgtcatattttctttattcagtcatccactgatagacatttaggttgattccataccatgacaatcacgaatagtgctgcaataaacattggggtacagatttctcttcgatgtactgattaattttcctttggataaatggtcaatagtgagattactggtatgatcattttaatttaaggaggtattcatcaaactggttgataaaattaactagtcccagcttaagatatctgggatctagaagcactgtttatatactttgcatgagacacagttctaaccatacaattaaaaaaaaaaaagattccaagcagttcatacctgtagcctcagacttaagcttaccctctaattagttaaacattagggcaatgattttctgcctgtattttataaaatgtcttcatgctggtggtagagtgaatgtggaggaaaagaacatatttaagtggaggccattcatgatataagataccatggaaagcttgagttttcagtttaggctacagaaaatgcaaataaataaattaaacagttggtttaaaatattactacaagtaggattttcccctgaaggaaggcttggttttgtcatgttttatgctcggtttgttaggttttattgttggcttcatatgtctcttgctgatgggagtatgtgacgtcaccacacggcatagagaggaccaagaagctgtcccagtatcataacagaaggagactggaggcaatgtgagaaataaaaatgcagagttaagaggaggtttatacaaagaaagaactagggagtgcgaagaagagacataatttaaaagaaatgttttcttttattatggaaaaatatgctgtttatagtataatgtgaatcctcttctcattatttttactcaaacttcattaaaatatcaatttctggttgatgcgttgtgctttttaagagataccacgaaagaggacttaggtggttattctggaatatgggtatttacgatgagtaaggtgactattttcatgcaatcatttcagaatcagcactgtgagctgtcctgccttaagacaatcgttgcgcacatctatacaatactatctatttcactccaccaccataccaatcatcgagcgctggctgctcagcagggtgcggatgtgtacttgaccatagccatagtggttctcttgagatgcagacagtttctacactaaaaatgagttgacgtttaggagaaagaaagaacaatcttggtggtatccatttgaaaaagggaagcggaacttcaaggaaatattggcacaaaaactaagactgcttacaagaggattacctcatctgggttagaggaggatttcaaggatatgaggcgctctcatcacaataaagcagacattcccaacagtcacagaagcaggcaaatgaaagatgatgtaaacttatataagacttgagttgcttcatcttaagcatccatccaatttcagtacatgggttcttttgctgtttcaaagttctttttttttcttttagtactgtacatttccatataaactttcattcagagtttttacttttaaataatttctgtagctgccttttgtacttatttgaagaataattgaaaagaaaaaaattgagaaaattaaaacagatttctttttgccaaaagaaagtattggtaatttatagcaaagctggaaacgagggcctcttaagagttttccaaagtatgtcagctagtagcatggggttttagatcttttctttactgcaatcaatcctgctggaaatatgaagtcagttcagaagatcagtagagttgagctagcaaaagaataaaaatcctgaaaggagttattaattatgtgcatactgtgtgcagacagaatcagaagatactggccaagacattatgaaacaaggaagaattcacgagaaactttgaaattgccatatgcaagatgcaagttccctttacccaattttgcactcatcttctgatgctagaaaagcaaatgagaatgttgctaacacaaatgttatgtatttgcactgatcgagatgggtgagttcaacaagggaatccagtctcagtgtggattactgataaatgtccttgcttttgtgctagcctaaatttctagtgttgagagacacattttgtgtagattccctatttatattacattaactaagtatcttgaggatatgatgatttcagtaaatgtcattcacacaatccatcaatagtcccggggtggaggggcgttatcagctattgtttctctgaataagtattatcaaacattgcttttctgctatacagaagcactatggaatgaaaccacaaagtctgtagacaatgtttttgcacactgtaaaaattttataaagtcaggtttcatttaatttacacttttgtttctggttagtgtttttactataatttgggaataatgtacagtggtaaatcattgtgaagtaacactgcattctccttaaaattgggatgtattcaggcatattaattatttcaggattcattaaatataattctaaaagagtttctctttaaatatttatctactcttgactggtcgtattgaatctcacattcattactaaaataaatttaagaggccttgataattgcagaccaaatatatagttacaattgtcgctatttataaagaggttcaagaactctaacctataattcacattaagttgaggcatcaaagaaaaaaatacacaaaaaaggcatgttggcagtgatggtggtactaccaaaggtagagttgggtttcattcctttcctgttccagcctatctattgcttttaaataacttatgctgctcgtgtgtgaagggatttctccttttactcacatatttacaacctctaattcaggagagagattagagatagagaatctaatacccttttaagttgcaggactataaaaacaaaataggcctcactccacttttctaaggcaagattctaggaaaggataaatatattcatgagtcaaaatccactacaatgaaataagtaaccaagggtaaatatattcatgagtcaaaatccactacaatgaagtaagtaacctaggttactgaccagaactctgcattgaggataaagccaaattctttataacctcaactctgtcagagttggtagtaatcaggactaggattcagtaataagcacttttatttaatatatatatttatctgtctctctctctctatatatatatgtatatatatatatatacacacacatatgtgtatatatatatacactcatatatgtgtgtatatatatacacacatatatatgtatatatatacacacatatatgtgtgtatatatatatacacacacatatatatagcatttcttcccctttctgttcaatacagcacactgattctttcctactatgtgatgctccgggctggtatgtaaatcaagaggcctgccttccctagccaaaatgtgaacacagcagagagttagcagggtgtaaatgaatcctactgtcattcccaataatttgaactgtgagtacaatgacacaagaatgagaaaaataaatggacttcattcattcaattggtggtgctctatcaacattgtcgatttgtgcttcctacatagacccctgaggctttactgcagcatttttataaactagtctcattctcaaaccttctcaacatttgtgtgggctaatattctccagaaaagatccttttatgattaaattggccactattggtttatgttcatgcaactacagaatcataatttatagcacatggcaagcatataagaaatatttgcacttattcttataaacagcagtggtaaattctacattgtttagccctttggggtggtttgcttgaattctatatagaattacaaaatgttccgcagagaagttctcaaataattcttgctgtcattcatgtaagataagtaagacactacttcgtgtgaggtgccacacataagttctagggaatacttcatcacttttgagcaagccagcaagaaagcccttaccacaaggaggatatattttaagagaaagagaaatgtgagtcaatcagttttgatagcttatatgcaatggacagttatcagtctgagcttacattacatttactaacgtaaatacaaaaatctttgggacatggtgagagatgtcagcattagctagctgtgggtcagctgtttactgcaaaacctgcaaggcttgggaactgggagaactgtttgttctcaagaggagacgtgaaacccgaaatatctcccttgaggatgggattttttaatgtacaattctttatatttttcactaaaatctatgtaattttctttcacaatcaacataatctgacaaaaatgagctgttcctcataatattgagacattcttggaaacattttgaggaaggaaagcttaggaaaacactatcaagtttctggccaaagagtagggctccacacatcaggatttgaggtatgaataaaaatgaggcatttttacactcatcaggtgataaagcaattgtgtaaaaaaaaaaaaaaaaaagaaaattctagaatataaattatcttttaacgaatgagaacaaattactttggagatatttggtagcttccttaatcatagtagctttgaatgatatagatgcccgattgtcaacagagatcaaaactaaatcagaaacttaaaatggcccaataaaatgtaaagctccttagaaaaacagcattgctataaagtctcaaatacagtaatgtgggagaaaatgacacgcacagcctatggtaagggataagagctgcaatatggagaagtttatcttggattctattttattacctctacctaagccactttttaataaaaatcatcaacagttcacaccataaaacattttggacctagcccaagtgagaaaagtcaaatatatttatatatgttttttggctttttaagagattatttattttttattatactttaagttctggggtacatatgcaggacgtgcaggtttgttacataggtatacacttgctatggtggtttgctgcacccatcaacccatcatctacattaggtatttctcctaatgttatccctcccctagcccaccatcccccgacaggccctaagtcaaatatattttatatgagatccatagtactcacaaaatttaatacatctatgtagacattgtcaaatataggaagacacttaacatatttctttgaatatactgaccctttttatatattaatgcctgtgtatcaaagtacatttcatacacagtttatcttctcctgaaatgtgattataaaattgatactctacaactgatgaaaagctagtaattgaaatgaagtcattctaatgaagcaataacactaacatagttttccaataaatatactgtgaatgacttagcctatggaaaaaggttttgaataaaaattattattttctaaatatctgaactgtaagatattagttctctaaatctatcttttttcttttccctggatttgaatatcatagctcactaaacatctttacaatttgcttcctctaaacacattctttcttctggaaataaaatggtgctttgaaagaatattaccaataggaagacatatttcaaacacgaggttcctgctttcaattacctaacagctggtactatgcgtttacatttagaaagacaaaaccttacaaagatgtattatgctttttcaagtaatttagatttgtcacagtgcaagaaaaactcattggcaaataattcaaataggcttgtaagtctcagagataaggggctttaaaaaaagcaaaatacattctttaataagcaaagttatgagacagatctataaaatagaattgagaaatctttcaaagtattccatgcagaacagctgatttagtaacctactgtgaaaagaactattgatactccaatagcagcggtgatacagtgaaaaggtaaattttgaggatgcgatatgactgcttgatctagtagtacaatactgtgaacaagcagggactttgcagctagacgtatttaagttccagttctgactccataatttacactgctgtggttcacttaaaactctgtgagcctcagtttctatatctttaaaattaggctaataatgcctatgtaagtgttgtgaaatgctcagaaatataaactaaaatcaatgctattgttttcctgtcatctggcaaagagtattgctccaattttatgtgtcaagtaatgtaaaacgtaaaagtactaacctaccaaatctgttctttttctaattgattacagaagaatccattaactttagtggcaagaatgtctgttatctctcaattgttctctcccttcaggctgatttttttgctaatatctttggtgctgagataatccaaaagagaacccccatctcctttagtggcagagctggcacaagcttatacacgacctcagggacctaagaactagcccaccaagcttgctaccactggagtccccaacacatccagtggtagtactgccacacacaggagagctggccagcccaatatctttctctccagcaaggcctcaccacagtctctacaaacaactgtagtctatgctaccaagacactcacccataccactgatgttaattgaagtcagagaaatcacatggagactatactaatgtgcccaccagaacccaagccaaagcactctaccaaaccaacactctaggacacatctacaggaaaaaaagtcttttcctataaaagctactccataaaattggaagaagaaactattccaccagttgcacagatatcaatggagggatacaaaacaggtaaatgcaaggaaacgtgacactttcaaaggaacaaaataattttccagtaagagaacccatctctaaaaggaaatctatggaatgcttgaaaaagaataataataattaacaaagaaacagatacaagaaaacacagaaaaaatgtttaaataataagaaaaataatttatgatctgaatgagaaattcaacaaaaagataggtatcatgagaaaaaatcgagcagaaactctggaactggaaaattcagtgactgaaatgataaatactactgagggctttaaccataaagtaggaattttttacttgaagacatcttttgaaataacctcatcaaataaggagaaagaaacaaggaaagaaagaatgatgaaaaggaaaaaagaaagcaaagtaaacatagtaaagaaagcctgtgagacatatggaacatcattcagcaaataaatatttgcattatgaagtttctgatgaagataagaattcatagaaaacgtgcttaataaagtaagagctgaaaaattcccaagtcttcagagagatatggacttccagagtcagaaagattaaagatttcctagtagattcaacccagagggttttcttatcgatacttatagtaaaactatcaaaagtaaaagacaaagagaattatggatactggagtctccaaagtggggaggctgggaggggaataagagagacaaaaagccacatattgggtacaatcttcaccactcaagtgatgggtgcactataatctcagactttaccaattgtattaatctgttttcataatgctataaagaactgcccaagactgggcaatttacaaagaagagttttaattgactcagagttcagcctggctagggaggcatcaggaaacttacaatcatggcagaaggcaaaggggaaacaaggcacctttttcacacggcggcaggaaggagaagtgtcaagtgaagggagaagaacttattacaccatgaggtcctatgggaactcactcactatcatgagaacagcatgcaagaaattgcccccaggatttaattagctccacctagcctcttccttgatacatgagggttatagggattatgagggttacagttcaagattagatttggttgaggacacacggcctaaccatatctccactatacaatttatccatgtaatcaaagaccacttgtacacctaaagctactgaaattttaaaaaataaaaaaataaataaaaagatcttagaataataataataaaaaaaaaaaagcaagagaaaagtgttgtcacatgtaggggaatttttaccagactaagagcagatttcgcggtagaaatgtaacaagccaggaataatgggataatagattcaaagtgctgaaagaaaaaaataaaagttggtcaaaaatactatgtccagcaaagctactgtttagccatgaagaagaagtaaagtctttcctatatggacaaaaactaagagaatcaattcatcaccactagattggcctgaaaataaatgcttaagggagtccaacatctggaagcaaacagatgatatctaacatcatgaaatcatgcaaaagtagaattactgatggagaaaaatgtaatccaaggaaaattgtggtgctatgatcagaaggcaaaaataaatactgggaaaaaggcaatatatatttgtataactctgcataatcatataatatattactgctttttgttttgtttatatctttatacatgctggttttggtcttgaataatctgaagatgaatctatgtgaatgaattaatttttatatattttattttttctacctctgacttcacccagctcccaacccccatcgcatactgaacccattaatggcttcatttccatcatgtcagtcatcagtccttctctaagccccaagacatccctgaccaagacaggaagtgtgcctgcatttcagaacggaacacagagttcatctacccgatatgacccaaatatcagatcagaagaagatacagagcaggcaaaacacaaaaaggaaaggcagcataaagtcagttccattttataaaaatgcctttcttttttactcttcttggaaaataacttcttgttctcaaacttttggtgatcagaaaaaaaaaataactttatttttttctttctgatacataggagcctggagcctgcctcaacatttttttctcttattgttctacctagctgcatacctcagtattaatactagaataaaatgtattttgcttttctttcacaatcccctcctcctttcttaagcttcatattttagctctctaattaactcccaagtagggtaatacctaataagcattatgtatacaattcctgagagactatttaagaaacaacccatagagttatcccttgcatacctttgatgagtttcctggatccccttttgatctggattaattaatgttcctgagggagtgctgattttctagcattcttccacctttgatgcagaatctcaaaattcccttgtacaataactttgggtagcaacatgaacgcaaatggctgttcagatttcaagaccttctatactaattctttgtaaacttaggctgagacaagggggaaaaaagcatgtagcaccctggataaatcttaaattctgccatcagagctaagatttaccgtcatctgtttctgcagagacagacatttttttttaaaaggcatcctatgcttgactctaaatcctcacttatatcttcatcaccatctagagatggagcacctcagggaagttccagggattgccatcagcacccccttctctctgatacgttgttaaaggtttcctttctaataaataatttattgagttcctagagctatagactgaagtgtttattttggattctacattttttcattcaataaatgtattgagtgtccacacttatgatataatatgcacttatacttctccaggtaaagtaatataagaaattgtactgattggtgcaattactgaaagtgaaagtcccataatcaccgtcagttataattctgtgcttttagaatatatgacacaaaaccggcagcttgatgagagcatagcagtcatgcattcatctgtatatcaatgctaggataatatcatctgaggagtccatagttaaagtctcgaatgtagcttttgaatgaatcatatatgacatacataatcagcaagaacagacacatgattctactacttcactctattccaccagttaaagtttgagctcctaggagaagatctttcatatacaagacttttccaaaataacagataaaaacatagacacaatagtcccaaaaatattttcagagaattcaggcaagttatttttcaagtatccatgataatgctctgtttatagaagtcaaagacataaagtacagattattcacaagaaacagctgtcttgagaaacaaatctgatttattcatttaataaacatttgttggcaccatgcaggtcagtactgttgggaatatagtcataagaaagatacgtttttattaaagcagaattttaaatgaagggtatgctttgtggaataggattttatagatctttgaatttatgtcaatacaatgaaatgacaaaccgtagtttcttatcatttagtcttcaatatatgactttaggttttcttcttatcaatctgttcctgttactaagaaaacaatttatagtattttataataatgagaataaaatcaaatagggtatggcaggtcttcatattattattacaattgttcttttataacttgtatccattgcaattttctttgctaatttcctcaaaagttaactatgtaaagatattatatttctatataatatctctagatttgtttgttctaggttttacttgtctaacctagaagattatcctacaaagtccatggcctttaattatctaactttgaaggtatcatctttagatagaatgccaattttgattctaaaaaacttgatcttgctgtacatgtgaatcacataatgcagttaattggttcattaattatctataaaaatgtggaaaaagtcctaaatggttgacaaatatatgctaaaagcagggtataaatataggccaacatttaaaaggtttccaaaatattctacataaagataaaaaggaaaaaaaaacaatttttacaaaaatcatcttaatgtatgctttgtgacagttacacaaatatataaagtgtatgatacaatcctttatctaaaagcatttatttttcaagttttgaacttgactttttagaaaatatgtctaagtttttacatatcattatgtgatagtcaacaatagtgtcaaaattctaaacaatttgattcaatgtgagaggctactgcaatgtttctcacttcagttactcttaagtattctcttctgcaaggcaagttacactacctctatattatctaaaagtgactcttctccaggcatcaagagtgcagaacatgacaggatgagccagtatggacttttcaccttcccttcatggggcagaaaaacattcaggaaatcagagattttcagtttaatcatcagggcatgaacctcagggctcaaagctgctgagagccaacatacggattttgaggacagattcaactagcaaagccaatggagagatgcatcccaaattcatgtttgagccttaagttcagcgaagcttgtagcaagccagttatatatcactaggttttcaattagttagaacaataaatttatttatcttctcttttgaataaacttatttaggcagaaagagagtatccgagagagcgtgaataaacagcatgagaaaacttggaatatcttagcaacgcaatgacaccataagactggcagcactgtagagaaaacagagtaagaaagaagagaggcacaggaaggggagaaacaaaaaataggaagggtgaccatcaggtgaaaaataatgagaactttcaggaacatatgggaggaaggtttgactctaaagctattaaggggatagaattaacaggaaaaaatatagcatttgaaatacgagcagaaacaaacagggataaaacagggctgatatatgggtttcaagcttgtaatatgatattagatgttattagtagacgaaataagattataatgaagaaaaattagaggttaggaagcagggatggagaagagatcatgaacttagttttacaccttatgaatctgaaataatcatgggatatccaaatgaaagttccaagagacagttggttatgcaggtctgagctatggaataaaatttggagatgtcagagatacaattttagctgccatctatagacagaaattagttaagaatttaacggtagataaaataaatcagaagtaatatggaaggctggaggggaaaaaaataagaaagtatatctgagaacattaacgtgtgagatatacatagagtaagaagagcttgaaagtaaacctaaaatctgtcttcagtaataagatttaaaatgtaaataattataaacaaaaaataaacaaaaggtgaaagttatgctatgtaaaagtaggcagaggagagattctaagatgggggaaaagtcagcaatagcaagtaatgcagatgggtcaaatcttccattgagtttagcaagtcattggtgacaactggtatggggcatctcagaaaaatagtaaaggtggaagtaagattgcagtagagaaagtggaattgcattaataattcactcaatgggtcatcgagtttgaagttgaattcaaacttatgaatctaattctttatagaatcaaggtcctctagaaacttggtcatttcctatatgaaactttcaaagaagatatttatattccccatgagaataatactaactacatggaatatggggtcacattgaatgtctcaggaattgttgctgattttttttctatgagaaagcataagtacgtctaatatagtgaatggctcccaaaacattcatatttaaaattcatttgacaaccaatatataacataacatttataagaatgtctttggtatgaccaacaccaaagcaaatacaaaaacaaaaatccttaaagacatactatgtgtgaatgttataagttatccaaaaatcttgtttctattttgtcccttgttaaatttttaccctatgacttgctgagaagctgcaggagagagaatttcctgatgagttgtctaacagcttattctttcctcctgctatgtcctcaacatctatgttcaatattaaattgcactgcagcggagatgactgtgtgtgtgtgtatgtgtgtgtgtgctttaagcaaaagacagaggcttgagtgatttagtagctacaaatataaatcactgacaagcaattaacatatactttggttcaaaaccaaatatttccttagcaacaatcataatcactattttacagtgaaaattggcatatttatgatatgttgacattaagatattcagtaagcatattgatgtttaaattccatgtttaaatgcaactatttataaatcaatcatcccacaatcaccttttcttaattttgaagtgcaaatatgtgagtttaagattttagattgaccaaagtgcttatttgttttcttccacatagctcagtttaaaatttgtaaaaagtattaaaccacaggaaagaaaagtgataaaagcaaatatgtgattcagcaagtttcttaatgtttgaaagtaaatggaaggtcataattatttaaagcagaatacaaaaatatcacattgaaaatggcaaaattgggtgagtatggataacatacactatcaaattgactggagaaaatacgacaaacttaacaaataagggtagcatgaaaatcaagaaagattagtggtgtcagttaaaatattaaataaaagtataggtaaattagggggatccttccccaagttctgagcaattttcccataagacttctccttccccataactaagattttattttctgaagaaattgtcagagagccaccagacttttaagtcaaagaaagtaaggccaattctttgcttgagtacaggaatgtctacctgctgacaagctctgctcatacacagaagatttccaaagagcatctcagtgcccagccactagtgacagtgacaactatctattaaaaatccacacacacatttttacatatgtatatatttacatatatatatatacctatatatgtaaaaaatatatatatgtatttccctcatcttttagaacacaacaagagtatttatctcaacttcccaatagttaaacttggccttgtgactgagttctagacaaaggcaggtgagaagtcccatgtgccacatcccatcctatcttgatttatgaaaccttctttgcaggctgcttatttttttcccgcagaaagttgtctggggtaacaaatcctctgagcgagcttggaagccatgtgttgcagatcattcccctggccccaaggtcctgttgacttaaaatccacccacacagagatacatgaaaaataataaacactgaacaattacacgtgaagatatatatgtttccattgcctacatactcatctaataatttaatgtgaatggagaagcaggattaatcagcctctttgaataaaacctgaaaccctaaaaatggaaaataaaacagaataaaaaataaaaggtgggaatagggagaggaaataatagagaggtagctaaataaaactgctttaaaataaacatcctcacaaagataagaaaatataattttaaaaaagcaaatgacttagaggataagaatgagatcttgagagaaaaatattaagacccacaaacaaaaataacaataacaacaaaaatactcaaaatactcctagaccaattatctttcaatcctaacacagcacctgaactgcttttcatgtttactaataacctccatttttgaaaccagtaattatttatcagttcctgtctttttggaatcattaatggtatttgaaacaattgatccttataagggcccagagctcttcttttcttaaaataaaagaaatatgaggtagtactcagcaatcaagtagtccagataggtcaaatcttccattgaatttagcaagtcattggtgacaacaggtatggggcatctcagaaaaatagcaaaggtggaagcaagattgcagtagagagagtggaattgcattaataattcactcaatgggtcactgagtttgaagttgaattcaaactggagaatctaatcctttatagaatcacagtcccttagaaaccttgacctcttcttttcttaaaatttaaggtccacagaccttttcttttcttaaaatttatatccagcccaacttctcttctaagctctaaacttgcagggttatctaatttgtatgcattatactcatctcaaacgtaacatgtttaaaaatgagatcttaatttgcctttctaagctcatgctaatcttcccatctcagtgacaattttaaaaatcctgaagtcatccaatctctctctctacttcatatctcacatttaagccatcaatacattatggtgattctatctttaaaatgtattcagaatcaaaaccacttctgaccaccgcactgctaataccttaggctgagccaccatttctttgtgcctaaattattgcttgggctccttaatttctcatttctgctctcatctacctgttgactatttccacagagcagggagagtagcacctttacaatgtgcattaggaagacttctgatttcattaagaagcccctcttgttacaacacaaaagccctgtacacaacacaattaatgagcatagaatgaccctgagaagtagaaagaacaaggtgaactggctagagacctaagggccaacaacaacatggcagtgagccctctgggtttccttattctggcccataatctggggcagggctccaaaatggactggaatatagatgcaggtccaaaaagctccaagaaaaatatctttactctaaacaaaggaccagaaaaatggtggtctaaaaacagaaaaagttttgggaaatacttgcctactccagccaaataccaaggacaaaaattgcaccatctctaccccactagtgacttcagcaatgtcaagtagggagcagatttttcacaaatgacaaccttgcttctgagaaagcaggtagctgccactaaattcatctactcaaggagctgtgatgaatggttttgtgtgtcaacttgactgggcgataagatacccgaatacttggttaaacattattctgggtgtgcctgtaaaggtgtttctgaatgacattaacatttgaattggtaaactgagtaaagcagactgacaacccaagtgtggatgcgctttatctaaaccactgaagtcccgaacagaacaaaagttgctctccctacctgtcttcaagctgggacgtgagtcctttaccatcagacttgaactcagactggatcaataccatcagtattcctggatctccagcttgctgactgcagatctagggacttctcattctctgtgattacttgggacaatttcttgtctatctatctacagatagacagacaaataggtaacctatttgtcacctatctaatttcctattcattctgtatctccagagaaccctgacaaatacagtaatatagccaggttgagcactggcagggtgggatcttatatctcattcactaccagaaagaaggaaatgtactgagtcccccattcccaactcctacccatatcatgctgttagcagagtcctccacctggaccaccaggtgagctaggtgagcctctattcctacccagtaccaagctgacttaattaaggaggcaatatgaggatgatcttgtcaattgtaggctccactccactactccatgtcaccaccagcacccaatatcagtaggctcaggggaactgaaccttcatccccacctgggcatcaatgagattgaaactgtgttgcaagtctaggctagttagcactgcgctttatccccacccttggtgtcagggatattgagtagctgagcctccacacccattctgcagcaaaaaagtattgcaagtcaattctctattttcaatatctctggtggctctgggatacaggagggaagctgagattttatacacccacccagaggcaatgaggcagtataagtctgggtcttaaaactgctgaaaggaggactgccattctgaaaaatcatggaatttagtggccagcatttttgaagacttagaaaaatttatttttctaagtcaatttatctattgactatcatgatctgtggaatgtctcaaaaaaatttaaagatacaggttcagcaaagtaagctgaaaaaggcatgaattaatgatagaaaaataaaaaattagaaaagaatcacaatctatttttgcatattgtagtaaagtagccataatttatatatgtatatatatgcttatatatacatatatacacacatatatatacatatataaacatatatatacatatatatacacttgtgtatatatatgtaaaactgtgcttagaacttggggtaggataaaaaatgagctgatggtataaaataaccaaatgttaaatagcgtaataggaagaaaacaatatcttgaatcagtaaatcaaaagataacatcataatcatgttatttaaaaatatgtgaataaataaaataagaaacatcacaaaaaagggtttacaaagttgtataggaaaacttgactaaggggcaggaatgtgttcttttttttttcattatactcacaatttaatgttcttttttgaaaacaatgcacagctatttctttgattaaaataatcatgaattctaagaaactgctttgagatatatatatatttcctttaagatatatatttctttcctttaagatatatataagatatatatatatcttatatatatcttaaaggaaatataatctacatcaaaatggcaactatttactaaacatgcattttattacataaacacacagcaatgctctttgctttggcattttctcaattacacaatatcttccattcaagttaccatctcctaaaaagttatttgagaaaatcttatttctcacaatgaaaccttattatctgaagctcagctgaatattgttctatccttagccctaatttacaaatacaaaataataattaatataatgtatgctattgaaagctcagtatatcctgagtggaaatttttcaataaaccttataaatatgcctgaaatgtttgctgtcatttttttgaaaaatattagcacaccaatgcaactatagctaatgttccaaatggagtattttatttcatgcttaccgtatcagatggaatgtaaggttaacagactttcaacacctcttaaatgaagggcttcatgcacacacattcagaagtaaaattaatcagaggggcaaaatctgtacctacctggtagaggttaaatggatggcatatttaaaatcaccattcatagctcctggcacacagtagactctaaatattttttccttctatcatttataagataaattcaacaacacatcaaagaaagtaggaaaataaacattcaaaccaaactcttgcattcattcctagattgctttttttaaaacatagtcaaacagtagtaataacaaatttagtaaaaagttctgaattgtaaaattcaaaaattgtttaagttcaaatttttaacataaaattgaaaatcaaaatttgagtactttactttctggcaaatctctttatttatcataatctgccttatagctagggatagccttagtactttcatattatacattttcacttacaaaccatacacattctttatgatgatatttctcccatcttttcttgaaattcagaaaaagaagtatatgtgtgtctcatttaaaattctccacacttcttagttttatactttttttctaacttaatggtccacttttccttgtccttggtcgatcttcactcatcttactataaacattcacttactttttaaaaattcctaccgcctctctcttccaaaaccagtccttatattaagtaattaaataaaaatgaccaagtcaccaccaggacaaaataaatgtccattctcaaaactattacttcagttggccttaagaaagtaggatggacagtagggagatatcttttctagtaattctgcaaatcaataccaccattctctgcaaagcagacaggaggaaattgattgtttcattgcaatgtttcatattaaaaaaccaaaacatcatttcagcttttccatactctatggaaactaatattcagagcaaatatgtattctttcatcaaatatttattgagtacttaccaaattttggacactgagctagttagtggaattactaaaatacaacgtgcaaggccacaaatgaaatatgctttttcatttaattgagagcaagactatgagatagaaaataatacctgagttttccaggtgatgcaactatagcttatcaatattaaattactcactatattctgtgcagaataagggttgaaacaaggatttaacttgacctctgatgccttgacctctgatgacaatgcttttgctttcaagaattatacctaaataattatgttgatgtcaaggatgatgatgatgataagtatcaatctccatttactgaaatataccttggtttcaggtcctgtgcttgcatgctttatgtatgtgaattacatccttttatcaccctttacagagagaaaccaaggctcagagaagttaaacaacttgatccttgctggtaagggagtggaatagaattaaagctcaattccatctggttctgtattcttttctttaccatcaattctctatagcaacagttattgaaacttgaagacccatctcacagcctctctcttacatacacacatttaatttcattctccatgcttggatcacaggctctcttctctgtctttctacattatctatctatctatctatctatctatctatctatctatctatctatctatgtatctatgtatctatctatctatctatctatctatctatctatctatcatcatcatctaggtatctatatctatatatcaaccttcctattatctgtatgtatgcctgtctcagtctccctttctgtctctatctctcagactttctgtctctatatccctttccctatctctttacatttttttgtttcattttgattattatttgtctttctggcaatctgtctatttctgtctttcttgaccctgtgttttcccggcctgtctgtcactctgcttctacctttctgtctcaacctatctccacttctctctctttctgttcttttctaagtgtatatctcagtttctctttctgttccctttctctttttcttatatttgactgtctctaacttttattatgtttttccctgtgagtctctctcattttctttgtgtgactatccctgtatctctctttgagtttgtatctctgtgaatatctttctgtgacttatctgtgtctgtctctgtctctcggacagagatgtaagattctaaagtaataaaaacctctcatccagttttaatgacccttttctggattccagtgatgtgctgcaaagttgaagaaataagtcccttaaatgataaagcaaaaagaaaagtcactgtccttggataaacaatttgcatttccataaggattcagtgatgcagaatcagaaaaggctcattctgacacctccatgaaaacaacagggagagcattcattagctgggcttccttttgaatgatgcacttcattgcacacaccgctgtcctcccccggtcaggaaacagtgcttaattctatcggaagtttgccctttcactaggcatgagaatgaatgacttttcaaagtaataggaactacacatctgccatggcctgagaatgcttacactctaaaagccatacagaaagttacacctcctatcaatttcttatccatcaaggaacacaataaacaagctttgaacttttccatttaccaacttgaaggaaagaaatgcttcattttctttagttttttgaaataatgactgcttttgcctcttacatttatagcttcaatagccatgatctaattttaagggtgaatgcaacctttaaacaaggtttatgatataaaaggaaatttgtccattacagtgctcagaaacttttactctttaggtgaaaattattttgttgctgttattgttgaaacacacacacacacacacacacacacacacacacacacacacacgatcatcttaggaagtaattggacaagattaaaacaattaattgtatttaaaattatttagcaatttacaggtttcttattcattttgctggcttcatttataagttatgtattttaaatgtggacactgaggaacaaatgtttagagggtgtgctgaggttctcaaggaaaataattgttgtccttcggacagaatatgatgtttctatgctccttatattaataaatagcacacatgtgtatgtgtgggcagggggggagcggggtgtgtccatcttactcagcgtgactgacttttaggctgagattaagtcatactcgtctacatattcttccaagtctctcacttcagtttatacaccacagttgaaaattgtattttaaggtcaagctagtcgctctcacattcaaaactacctcccatcctgcccctgccatccatacatgcaacgaattaacatgtgcatttggaatttctgggtgtattctcggttcttgtcaccatttcaacctaagtgcttccagtattcaatttaaataaacgttacagtttctgggtgatttacacctctggaatttctatggcgactctatcaagagaaaataatctggccataaattactcacattagctttttttttttcctcactcaaaattgactatgagcactaatgagtcaccacacttccttccaatacccttggatgcaactcagtcatatttgagtctgaaactaataaatgaagccccacaggtcactgttagttttgaatccacattctctcatgctatagtgttaacgacaacaacaaaatcccattacaaaagaaaatatatcaaacctcaaacaaagttttagttgagagtaacaaaaatagtttttggatgccatccctgacaagtaaaacaatcttttcaatattataattgtatagtcttattttgcatgtgaaaaccacagatacatagaatgacaaaatgattctagttcacaagtggtcccgatactaagaactcttttaaaaaatggaaaaatacaaacaaaatgactatgaccaaaacccactcttaaaatagagtctgaagtaaaattaaacttttagataataaatatgatcattttatgaagtagtgtggtctctttgtttagattattatttctgctaacttttccttgtgttcaaatcctgagtgaaacttaaaaccatgtatttctcccagcattagggctacaataaaatgtaaatgtatatggggggcttctgtgttaggaagaagttaatataacagctcgtttatgaaaagctattgttttacaccatttaagtaggaaaaaaagttcctacagtctgaaattgtatctgcacatttacagaaagggggagtacactcatctacccaataaagtagtcacatttatgaaattactttataatttttggttttacattttactattttgagaaggttcataatttgtctaaggagtaaaagtcctcatgataaagtgataacacaaaggaatcattaattcctcaacatgtatttgcttgacgtacgttttgtgatcaaataattatagtgatttcctttgataaaaataataattaccttttgcctttaatttcaaacataagctatgaaccaaatactggagaatttttgcaagtggcataaaaacaatttatgtctgcctatctgctgtgaaagttgtataataaaaagatacaacacataccatgcaaaatttaaatgtgaacaaattaagagcaaagttgtaatggacatttatttttcactgggtttttttaaagcataattattagtgttttttaaaactatagttcagatacttatcaaatattatcagtgggtataccatatttttaaacatttcctagaaaatgaaatgttttatttaaatctttttgtgaataatattcaaaacttcatgccataattttccagagaagttgctgacacttaggtagcacaaactctgacctgttcaggtcacttaatgattatgtttaagggtaatttggggggcaaagttgtagggattcacatttcctgctcagcacataattgcaacagctgaggggttaggaggtcgccactcagtggaattgggcacccattaaatggcacttttatttcataggagaatgagtccacagtcaaggggatcaagttgctgaaacttgaagacacacatgtacagatacattcactcattcacacttagccacaacttaagcaaactaaagaaactaatagtaaaaccaattttctgtgaaaagaaaacaaaaaaacagttcacatgagcatatacaacaaagcttcatacctgctgtgcaaaccacagcaagcattttgcgctcaaaatatgcctcttttacagattatttgtttctctaatgttaagcaacataataacttaagtatttggttactagatttgacaattggctcttttgtgaaagcaaatgagtatgacttggagttaaccttacaggaggccatcatattatactctagttaacaatggctttctgcatacgtgctacaagtccatcaaatcgatggccatctgtgtgtactagagacacagagtatcaacacactgaacctgaaacttgttattcagggcccacccactctatagctaccaaagtatattttttaaagtaaaggccacatcacaaagtgggaaagctgttaatactatctagcattaattctgtattagaaggatacagttgacctagattcaaattctaaatggttaatgcttccagatacgcacaaaggaagtaaatattctaataaactaaaacatccacagtaaaaatatcagtatactcacaaaagacaaaaaatactgttcattgtgaggcagaattagctactttaactcaactgccaactataacctccagcaacaaccactcataaaacaaatcatcaatatttgcacacagaaaaacaaaaagtcaattctgatgccatttttctgtattttttcaggttggaggaagtagaagaagtggttgaggactaaaaattcttttaaataacaaaccagagttataattcaaaagcttgtgtctttgtaaagattacattgtcatctaaacaaaattacaataccagacagtaatcaggaagaatgaaaggacaggcagttgtgttcactcttccagcaaataatcacttgcaatcattactactctattctttcaacaagcatgacagaaagtagcatcatgacagagatcattgtactgaaagaacatcttaactttctctgtggttcactgctgccttaaatttgaaaaaaataagagaagggcgggggaagaacttacttgcggtttaaagtttcatctttagtccatgtaagattatgcagcaagttttcttgccaaggctgcctcttgcacatccctttaaaaagaaccagtgctcataatctagttccaagacgattcattcacatgttccacctcttgtttctgtgaggcattgatatccactctcatatcatcaagaaaatgttactaggaaaatttttagaaaagcaaaacagttcaacatgttaactcagaaagcataccatcattctccacgttctgagatgtatgccacctgccttagttaccacaagcaactaacactaagctgctagcaggaatctgtctgccctctatctgtcgctattagctcagcacgttg
